United States Patent 7,745,391 (HUMAN THROMBOSPONDIN POLYPEPTIDE) - sequence listing, part 84

SEQ ID NO: 288558 - DNA, 1483 bp, Homo sapiens
cttaacagagtgaatcagaatattgaaaactggcaaattcaataaaggtttaaaaattatgacaataatatgttgaataaccactgctattttaatgttttatttatttatttgtttgtaatttttgtagagacagggtttcaccatgttgtccaggctggtctcaaactcctgggctcaagcaatctgcccacctcggcctcccaaaatgctgggattacaggggtgagccactgtgtccggcaaaccattgctattttaaaactagactatttcttaaactcctaaatagctttctcagataatagtagaaagggtacaataaatccaaaacaaacacaagtctgaaatttttcatctctagcctaccttaagcttatatattaaatatataattatttataattatataacaattaacaaataaacaatgtttatttctcaaaccaagtaactttctataaaaagaatatttatactgctagaacaagaaactggctgaacaaaagcaattgtctgataaatggctaaataagtaaggtttatttttaccatattaggtttctagaatgaaacaattttatagctaatctgacatctgtaatgtgacaactgtcttctcacataaatctctggtaactgtttatatacttttgggtaatacagaaaaatgacaaatattccaatttttaaaatgcaaaatatgtatgtagatgtatgtagagaatgcattaaaactttaaaagaattttcacacatttgatattttgatatacactgaattcataattattttgcccaaccccctaaaatttccaaagaaaatagacgagcaaggccttttctaccatatgagaggaaaaaaactagctaataaaatcagagtataatatataacaacttgcaagttcaaatataccatgcatactagatttttctccttgtttacttttagaaattttgagaagttttaattaattttaaaagaaaaaaacagccacagacaaaaccagcttataataaaaaggcaaaaagggaagttaatggttaaacccatgcatgcacctagccactcagcaaacctctctgaaagccccacaatattgccttctcaaaccatttcattgtcataaactcaggaataatatcctagctgtaatctagaaaaatgtctgtagtcctatgccccgcctgagggtggacaaaaactgggtcataaatgaatatttgctactcactcttcagtttccttgtcttctgctgaagtgcctggcaagtgttcgataattcagtatttatagtttgaaggttccgttgttccgaaattgcttcctctaatttatgcagtaaagacgtagctttttcactggcagtgtgggcttctcgatctcgatccttaccctggacatggatagttagtgctggattgtagcagtgtggccaggaaagaaagcaatggagtgctcactcttatgatgcaggc

SEQ ID NO: 288559 - DNA, 714 bp, Homo sapiens
aacccacttcctcccaggccctctagggggatggtcaggcttctgcagagatggggaggatcctttcctgactgcttcagctgccataacaaaatatcacagactggatggattaaacaacaaaaatttatttctcacagttctggaggctgggaagtccaagatcaaggtgtcagcaaggtgaagacactgacagtaagaaaaggcaaaccacaggtccaagacaaagtggtcaagtcaagaaggaactcaggctgtgtagtcctggtgcaaggctccttgcccccagcgtggggtcacactggctggctgtgctcccacgacacttagtgcatactgggctcctgacttaataacacgtgtttgaaatggcccctgattcccaatctgctgcaggattctgcagatgcgcaacaggccacagtggaaggtcttggagagaattcagagtggcttgcctacgttcccatgaccgtttgtcctaatgggagaatcaccattttggaaaattcttttggaggccaggcgcggtggctcatgcctgtaatttcagcactttgggaggctgaggcaggcagatcacctgaggtcagaagttcgagaccagcctgggcaacatagtgaaaccccatctctactaaaaatacaaaacttagcctggcatggtggtgcacacctgtagtcccagctacccgggaggctgaggcaagagaa

SEQ ID NO: 288560 - DNA, 1175 bp, Homo sapiens
ataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagttgtgactttactaggcaaaatggaacgtcttcggagttctcttcttcatgccagtatctctactgctcttgatagacacttggagtctattcacattgtacagtcacgtagaaaggatgaaattgttaatgcttccaatcggcaaaggcaaggagttcctagatgccaagatgacagagatgtttttgcccttgcttctgcaattaaagagatgtgtgtggctactcggaaaacacgcactgccctgtggtgtgcactgcagatgaccttgccaaaaacagccagtacagctgatgtgcattagtttgagagtatacttaactgtgacatacatagcagagtcccagaagaaagaactgactactaacaaattgaaacaagtacccttcaggggaccgtggatataacctgactccttcagtgacaaaaatcaaggctgaaactttcaaaatcccaaaa

SEQ ID NO: 288561 - DNA, 2568 bp, Homo sapiens
  misc_feature (2316)..(2316): n is a, c, g, or t
  misc_feature (2333)..(2333): n is a, c, g, or t
tactccaaaagtatttccattttattaattttgtctgttataactgtttcaagacagtctgtgttctactcaaactatagtcactattgtacaagtcagaaataaagtatcaatacttttaaatattttaatgataaaggacaggactttggttcaatcaataactatcctttttttacaaaaataacatttgatcatttagtagcaaaagcactgggttttgtaagatttaacagatatttaaatggcatttaatatgaaatgaccctgaatgtttattttacagatgtttttgcccttgcttctgcaattaaagagatgtgtgtggctactcggaaaacacgcactgccctgtggtgtgcactgcagatgaccttgccaaaaacagccagtacagctgatgtggtaaagcctttacaagatacagtaaactgtgaagataaagtccatgaaagcataaatagtagcaatccaatgaaccagagaggtgaaacaaacaaacattaaggaaatgccagcagaaagaagaataaaaagctgataaatatatcaagacatgctaaaaatgttttaatgaacttgtcaaactttcagtatgttttctttcagatttaaagttaataccagtaccttaatgaagtctaacttctatttaaaaatcttctatttgaagtgaatccgatatagttttaagtaaacgcaaaggtacagttgactactcagagttctgagtagtcagataacaagtttaagtaaattaaatatttcctaacagctaaaatgtgcttaaactcattctgccatgcaggtaaatgcaaatgtgaaattcttctaggagataaatttcatttaggtttgtcttagttaagtataattccaaataatgaatctaagtgactgtaacccaattacggctacagcctagtaaccaagacaagttttgattgtgatatcaaagtgttttccttacaaaactggataatacctgggaaacaaaggaaaatacggataaacccaatattcatgtacaaacttaatatttaaaatactatactaccatatttataaatttggaatcttaatgcctaggtatatggagggaaatgcatctgattctcctaaattaatgataaaagtgtcagtgtaaaaaccatgcaagttactgaatataaaacctattcagatcatttgtgtatattctttaaattttaattatattatcaattgttaaatgtttccaattttaaagttatttaaattgaatcacaaaacattccctttatctggatcttttagacttgatgcacagtaactgaaataatgactactgttttaatacccttagtttgctgccttttatgagggtgtcacgaagttctaaaatgtatttttttaaaggttaatctctaactagtttagcttgcaattggttagtgtatattttgtgtagttgtgttcattagtttgcttctaagttctaaaatgtattttttaaaggttaatctctaactagtttagcttgcaattggttagcctatattttgcgtagttgtgttcattagtttgcttctgtatttttttaaaactattgaaagcttaactttttctgtttctcatcacttagtatctttgtatagaacttgagtaatttattcgttaatatgaaatgttggtattatgtgactcagaagatcttgggttttaacatttctagcatgagttaaactataatgtactgatgaaatttaattgaaatatccttgactagaaacactgatgttttaaatgttagtgtttttcttagttttagaaattctggtattaaaaaaaaaaagagtgtaatcataccacataaattttctttagatgatgtgcagaagaaactgattgagaatgcaagagtaactgtagggagaaacattttgatcactgatatgccttagaactacccaaatgaattacattgagggtagtcaaataaaatagatcatctcaccacagtcactgcatagaaagtggttaagtttaacataagacatgttggatgttataaaaacaaatactgtactgaatttagtctcaggaaaaaaataaattactttgttgaaaacatttggtttcatttttctaaattcatatgtttctaaccttaagagtcactcatatcagaaagtcaaatgaatttcatttaagaacttatactaagttttagatttcattattaacgcacaagtaataatgttggtttataaatcaatgccattcagatatccatggatctaaccagatctccttcaaagatgaaatttttgctcnatctttatgctaatccntgtaaaccagaataaaaattttagggaagcttttacatgatactggtcagaaatgaaataccagtccgttaataagaaccaaacacttaaaaaaattctttgaaatattgttaatcatatcacccaatagataatttttaaattagtcggttgtccctttcagtggcatatcctctaacagatggttcttatgtacttgtatttctgaattacaacctataaaacattgtacttc

SEQ ID NO: 288562 - DNA, 2716 bp, Homo sapiens
ataaagcagccaaatggattttgtgataactattcagctcagaagtatgggataattgaaaatgtaaacaaacataattttcaagccaagccccagagtggacattatgatcctgaggaaggtccaaagcatttagatggcttatcacaaaatacataccaagatctactggagtcacagggtcattctaatagccacagaacgagaggtggagacaatagccgtgtgaatcgcacacaagtgtcatgcttttctaataattatatgatgggagatttaaggcataatcagtgttttcaacaacttggttcaaatgggtttcccctaagatccacccacccatttggccattcagttgttccactgttggattcctatgacttactttcttatgatgacttaagccatttgtacccttattttaatatgatgtatggtgataattctttttctggtctcatgccaacttttggatttcaaagaccaattaaaacccgtagtggaccagccagtgaacttcatattcgtctagaagagtgctgtgaacaatggagagcattagaaaaagagagaaaaaagactgaattagcccttgccaagaattatcctggaaaaaaagtatccagtactaacaacactccagttccaaggctgacttccaacccatctagagttgatcgcttaattgtggatgaacttcgagaactagccagagttgtgactttactaggcaaaatggaacgtcttcggagttctcttcttcatgccagtatctctactgctcttgatagacacttggagtctattcacattgtacagtcacgtagaaaggatgaaattgttaatgcttccaatcggcaaaggcaaggagttcctagatgccaagatgacagagatgtttttgcccttgcttctgcaattaaagagatgtgtgtggctactcggaaaacacgcactgccctgtggtgtgcactgcagatgaccttgccaaaaacagccagtacagctgatgtggtaaagcctttacaagatacagtaaactgtgaagataaagtccatgaaagcataaatagtagcaatccaatgaaccagagaggtgaaacaaacaaacattaaggaaatgccagcagaaagaagaataaaaagctgataaatatatcaagacatgctaaaaatgttttaatgaacttgtcaaactttcagtatgttttctttcagatttaaagttaataccagtaccttaatgaagtctaacttctatttaaaaatcttctatttgaagtgaatccgatatagttttaagtaaacgcaaaggtacagttgactactcagagttctgagtagtcagataacaagtttaagtaaattaaatatttcctaacagctaaaatgtgcttaaactcattctgccatgcaggtaaatgcaaatgtgaaattcttctaggagataaatttcatttaggtttgtcttagttaagtataattccaaataatgaatctaagtgactgtaacccaattacggctacagcctagtaaccaagacaagttttgattgtgatatcaaagtgttttccttacaaaactggataatacctgggaaacaaaggaaaatacggataaacccaatattcatgtacaaacttaatatttaaaatactatactaccatatttataaatttggaatcttaatgcctaggtatatggagggaaatgcatctgattctcctaaattaatgataaaagtgtcagtgtaaaaaccatgcaagttactgaatataaaacctattcagatcatttgtgtatattctttaaattttaattatattatcaattgttaaatgtttccaattttaaagttatttaaattgaatcacaaaacattccctttatctggatcttttagacttgatgcacagtaactgaaataatgactactgttttaatacccttagtttgctgccttttatgagggtgtcacgaagttctaaaatgtatttttttaaaggttaatctctaactagtttagcttgcaattggttagtgtatattttgtgtagttgtgttcattagtttgcttctaagttctaaaatgtattttttaaaggttaatctctaactagtttagcttgcaattggttagcctatattttgcgtagttgtgttcattagtttgcttctgtatttttttaaaactattgaaagcttaactttttctgtttctcatcacttagtatctttgtatagaacttgagtaatttattcgttaatatgaaatgttggtattatgtgactcagaagatcttgggttttaacatttctagcatgagttaaactataatgtactgatgaaatttaattgaaatatccttgactagaaacactgatgttttaaatgttagtgtttttcttagttttagaaattctggtattaaaaaaaaaaagagtgtaatcataccacataaattttctttagatgatgtgcagaagaaactgattgagaatgcaagagtaactgtagggagaaacattttgatcactgatatgccttagaactacccaaatgaattacattgagggtagtcaaataaaatagatcatctcaccacagtcactgcatagaaagtggttaagtttaacataagacatgttggatgttataaaaacaaatactgtactgaatttagtctcaggaaaaaaataaattactttgttga

SEQ ID NO: 288563 - DNA, 2403 bp, Homo sapiens
taatcagtcaagtacttctctttttagctcaaaactttttccattagattacaatacttcctaacaatgctgtttgcaggctggtctcttatttgtcaaaaacagtatcagatcttgtatttgcagttaatgacatggtaatgtttgaatatttaacattttcattgatgcttattttcagtaatcaactaccacatatttttagaattaacatagacaagtagatagaaaacactttccatttttgtttcccccagcatggtgtcaggacacagtaagcattctttgatttattgaatgaatattattgctgtcatctctattctgcttcactgaagatttgtttttacttaagttaatggcaggacatgtcttatcaaaatttaaaatgcttccctcaggttgtgactttactaggcaaaatggaacgtcttcggagttctcttcttcatgccagtatctctactgctcttgatagacacttggagtctattcacattgtacagtcacgtagaaaggatgaaattgttaatgcttccaatcggcaaaggcaaggagttcctagatgccaagatgacagagatgtttttgcccttgcttctgcaattaaagagatgtgtgtggctactcggaaaacacgcactgccctgtggtgtgcactgcagatgaccttgccaaaaacagccagtacagctgatgtggtaaagcctttacaagatacagtaaactgtgaagataaagtccatgaaagcataaatagtagcaatccaatgaaccagagaggtgaaacaaacaaacattaaggaaatgccagcagaaagaagaataaaaagctgataaatatatcaagacatgctaaaaatgttttaatgaacttgtcaaactttcagtatgttttctttcagatttaaagttaataccagtaccttaatgaagtctaacttctatttaaaaatcttctatttgaagtgaatccgatatagttttaagtaaacgcaaaggtacagttgactactcagagttctgagtagtcagataacaagtttaagtaaattaaatatttcctaacagctaaaatgtgcttaaactcattctgccatgcaggtaaatgcaaatgtgaaattcttctaggagataaatttcatttaggtttgtcttagttaagtataattccaaataatgaatctaagtgactgtaacccaattacggctacagcctagtaaccaagacaagttttgattgtgatatcaaagtgttttccttacaaaactggataatacctgggaaacaaaggaaaatacggataaacccaatattcatgtacaaacttaatatttaaaatactatactaccatatttataaatttggaatcttaatgcctaggtatatggagggaaatgcatctgattctcctaaattaatgataaaagtgtcagtgtaaaaaccatgcaagttactgaatataaaacctattcagatcatttgtgtatattctttaaattttaattatattatcaattgttaaatgtttccaattttaaagttatttaaattgaatcacaaaacattccctttatctggatcttttagacttgatgcacagtaactgaaataatgactactgttttaatacccttagtttgctgccttttatgagggtgtcacgaagttctaaaatgtatttttttaaaggttaatctctaactagtttagcttgcaattggttagtgtatattttgtgtagttgtgttcattagtttgcttctaagttctaaaatgtattttttaaaggttaatctctaactagtttagcttgcaattggttagcctatattttgcgtagttgtgttcattagtttgcttctgtatttttttaaaactattgaaagcttaactttttctgtttctcatcacttagtatctttgtatagaacttgagtaatttattcgttaatatgaaatgttggtattatgtgactcagaagatcttgggttttaacatttctagcatgagttaaactataatgtactgatgaaatttaattgaaatatccttgactagaaacactgatgttttaaatgttagtgtttttcttagttttagaaattctggtattaaaaaaaaaaagagtgtaatcataccacataaattttctttagatgatgtgcagaagaaactgattgagaatgcaagagtaactgtagggagaaacattttgatcactgatatgccttagaactacccaaatgaattacattgagggtagtcaaataaaatagatcatctcaccacagtcactgcatagaaagtggttaagtttaacataagacatgttggatgttataaaaacaaatactgtactgaatttagtctcaggaaaaaaataaattactttgttga

SEQ ID NO: 288564 - DNA, 442 bp, Homo sapiens
acccgagggccaggaagaactgctctcagatagccttgttccggaagtatcggttccacttcttttgttccatgcgctgcagggcttgggtttccctggaggagttggaagagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccaatgctaatggcagacatcaggaaggaggagaggaaccatttgtgcagatcatctagaagaacctggaccattcttgacagagctgaatacagtgatcacgttgtcctccaaggagcaggggtggggtggggtacttctaggagtccttggagaaaagtaagaaaccaggagtgtt

SEQ ID NO: 288565 - DNA, 220 bp, Homo sapiens
  misc_feature (3)..(3): n is a, c, g, or t
tgngtgattattatgcattgcatgcctgtgtcaaaacatctcatgtgcctcataaatacatatacccactatgtacccacgaaaattaaaaataaaagatggaaagccttggggagggggagaagaatgggtgtgaccattggagtggtgatggctctgtgcagtgtaatcaccagactttgtcagtgtcagtcccacagtgactcgggcaggtgcaggg

SEQ ID NO: 288566 - DNA, 273 bp, Homo sapiens
atctaggaatctgcccaccactcaagcctgggaaagctggcagaggatgcacgtgttttactcacctgagtgtttacaatgctcgtgaggtgcctccctgatagtacagaggaatgaagaaggaataaacagaccttctggataattgcatcagccttccccactattccaatgccatgctaacatttcaagtaatgtcccttttgtcttgctgagaaaaaatcatttcatgatttattacactggattaaaggctatgcacactctggagtt

SEQ ID NO: 288567 - DNA, 1547 bp, Homo sapiens
  misc_feature (724)..(724): n is a, c, g, or t
  misc_feature (753)..(753): n is a, c, g, or t
  misc_feature (1013)..(1013): n is a, c, g, or t
  misc_feature (1547)..(1547): n is a, c, g, or t
gcaataattaaaggatagaatggaagtgaaaaaactttctctattatgtgttattataaacctttttataaataaattttatgatatagcagatttatgaaatgttttatatttacttaatagactttgaattaaagtactttttgtgttgctgtagttttagaatgatcattttatgcgtaacagcagggacattcaaaataagctgttaagatgtgttgtgatttgcttaaagtctgatggcaagagagaaatcataaaatttaattttatcattcatagagcagcaaatcattggtgctcagggagaatatgttatacaactcttggtcgtatattgtggtataatgttagtttaaagacactaaagtatgggaatggattgtgtatgttcagtttacatattttgttttcctgtttacctcctttttgttttttccttttctcctttgtgttaagggttccagcatgaggcagggaattagttagacaggaagacactagaaggaaatggagtcacgatggcccaccctatcctaaatcaagaaaaatggtactgagtagttggatgctaaattttgaaacttagactgatcctgggatttaattctgacatttgcttgccagagtttgcctttatcacacattttctacttcttgcttaacaaaacaaatacacacacacacacacacacacacacacacacaccctcatgaagaactnatatttgcccatgtgatgaaagtgggggntaggacactttcactgtgtgtcattgtagcaagtatgtaagcttagacttcacctccctactttaaaaattgttcttccacttcctcttctgtagtcatgagtagcagtgcccccttgtagcccaaattctccactctagtcagccttactttcagctccaaattggatgtacttttactgaacttctttcaactttttattttgggtgctgtcacttgtactctatgtatcgatcaaatttatttttgtcagcctcaantaatactgctctatagtagggcaacattcattgcttaaaaacatacaaagttagtcacagaacaccatgacagatgtttgaatttttgattgaggatgttcttctgtaattatttttcaaatatcatgaataagcatataaggtatttaattcaacatttctgataaaagatttttgaaaaaattattttccaagtattttttggttttgtgctcaattcagtgtccttccaacatgtgtcagaaacccattgggccgggcgtggtggctcatgcctgtaatcccagcactttgggaggccgagtcgggtggatcacgaggtcaggagattgagaccatcctggctaacacagtgaaaccccatctctactaaaaatacaaaaaattagccaggcatggtggcgtgcgcctgtagtcccagctactcaggaggctgagccaggagaatggcgtgaacccaggaggcggatcttgtagtgagccgagatcacgccactgcactccagcctgggcgacagagcaagactctgtctn

SEQ ID NO: 288568 - DNA, 1876 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288569 - DNA, 1721 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288570 - DNA, 2160 bp, Homo sapiens
  misc_feature (529)..(529): n is a, c, g, or t
  misc_feature (817)..(817): n is a, c, g, or t
  misc_feature (1763)..(1763): n is a, c, g, or t
atatgtgaggtgatactttaagattgtatgaatacccttttcatctagtggctttagcatccattgatatttgtgcctttttttgtgattgcaaaatagtgattttctaactctatcatttcttctgcatttacaagctagcattgagcagtttgttccaggatgaagcaattaaaaataccagtgcttttgtgtgtgtgtgtgtgtgtgtgtgtgtgtgtgagagatatatttatgtgtgtgtatatatatgtgtttctaaatcataatataaaatacattaactggaatcatagccaaaaaatctcaaaagccactcatggtgtggagaacatagcagttgattagccgtggctttaaaattgaatcagtcctagaaagagaattccctttacctgggataccttgaaaagattcttgtgtgtttgttgttttggatttttaagaaatctcatcgagaagcatggtaggagttttatgtatagtgggtgggtatctatttcaaaaaatatttttgctaagtttattnttatttttctgctaactggaaataaatcttgtttttaatacatgtcattacacatctcctgttccaaaaaacctattcatactgtttttctctgaataaatattggcaaaatttttatatggtcaggagtgaatgacagcattcttatgtgcgagtattgtttcattttgttttataatgttgatgttgaaatggttattatagtcagaaaaagaatgaaagaaacaaagagaaactgccatcattatcaaatgagtctgagctccatatgcccctgatacaaccacntctctttaagagatgcacttccacagaaaaggtagttcccaaacttggctgatcattggaatcacttggaaactttgaattaaagattgttagccaattaaataggtgtgggacaaagcctagatgtcagaattctaaaaatattactgcttaggtaattctgatgatcaactaagtttggacaccattgccatagttttataaaaatgggaaaaactatacatacaactattataaagtaaatacattaaaccattatttatggttaaattgaagggggtagagtagctattgatgattttaattttattctttgcatgtttgtactttccatatttctataatgaatgttttttaaatcagaataaaacagaaaatgttatgttatgttatgttatgttaaaatatttatgtaaaacccttcttgtcctttatgctgcctttcctttgctttggctcaagtcaaataccacaaatgatgtttcatatggagcaaattaaatacaaatttatatatgcaactaagcaatatgaaaagcataacctagttttcaatccactaatgaacaaaatcaaatttctaatgctaatgtgagcaaaacgcaacagaacttgaattataaattgaattacccaaaaggtaatgaactgaattactaaatttgctgatcatatggaacaaatttaagtgtactgtttattttagtattgatcaaaaactttatttttaattctagaacagtcaaaatgagttctaaaaaaataagatatcggtgagcttactaaggcaagactcttattcaaatagaagtaacttttctaaaaccaaccttaaccatttataaaaaataaccatattaaaataatgtaacagtatgtagactcaaatttacaacaaaatcaaaaaagaaattgcttccttctcataccccaagatgcctttggnctatattttttaaatgaagtggtcccaaaatggtatgttgtaaataattttccctatttttttttttttttacagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288571 - DNA, 701 bp, Homo sapiens
  misc_feature (48)..(48): n is a, c, g, or t
agatcagatataagaataatttttttctattattaataatatataatnaaaatattcctccagggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288572 - DNA, 687 bp, Homo sapiens
  misc_feature (40)..(40): n is a, c, g, or t
tctcttatttattttgtttttttccaacaatacaacccanctcattctcagaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288573 - DNA, 1616 bp, Homo sapiens
acccgactcccaggccggcgaccgctgagcctcccgagacccccgtgggggccgctcgagtgacaggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288574 - DNA, 1628 bp, Homo sapiens
gggcgcgcccggggagcccggggagacgtcgcaggtggggaggagggaaacgtgagctgcgcgcaaagcttatggcccgttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288575 - DNA, 1620 bp, Homo sapiens
  misc_feature (18)..(18): n is a, c, g, or t
  misc_feature (34)..(34): n is a, c, g, or t
  misc_feature (70)..(70): n is a, c, g, or t
gcccgccggggagcgcgnaggagcgggtggtaanggagggagaggagggccagcgcggcagtaggcgctngttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288576 - DNA, 2183 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccactgaaaagaaaaaaaccatggcctcacctgcactcatccgccggcacatattacgaacccctatctttaccgctggaacgcgacactcgacctctactccctagctcacttccccccaccccgatccactcgtcgccacacacctcaggagccgttccgagcgtacccgagcgctcgcgacactgccccacgagccgcaccaagttgagaactcatgactatcgtccgagcggaggtagcacacagccatacgaagcgaatccccaagacggctgccctgcgcctaaagcggaagctgaacccctactg

SEQ ID NO: 288577 - DNA, 1943 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagatggggagtaggaggcaatgaggaagtcaagaggaaggggatctgaagtactccatcttggacacatctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288578 - DNA, 1967 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagacggtgtttcgccttgttggccaggctggtctggaactcctgacctcgtgatctgcccgcctctgcctcccaaagtgctgggattacaagtaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288579 - DNA, 1648 bp, Homo sapiens
tgccatggtggtttcctgcacctattgacccgtcctctaagttcccttccctaaccctccaccccgctacaggccctggtgtttgttgttcatgtgttctcactgttcaacttccaactatgagttaggtttcgcccagcgcaatttctttctctatgtactttgcgaataagtttcggagcatcggttaacagcctatgggtgaaatttggctttcattcatgaatgagaaattattcttgacagaagtattttaaaagaaaaatctttacgatggcctcagcagtacttagttctgttcccaccaccgcttctcgttttgccctgttacaagtggatagtggcagtggctctgattctgaacctggaaaaggtaaaggtcgaaatactggaaagtctcaaactttaggaagcaagtcaactacaaatgagaaaaaaagagagaaaagaagaaaaaagaaggaacagcaacagagtgaagcaaatgagctcaggaatcttgcttttaagaaaattccccagaaatcctcccatgctgtttgtaacgctcaacatgatcttccattgtcaaacccagtacagaaggattcacgagaagaaaattggcaagagtggagacaaagagatgagcagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288580 - DNA, 1442 bp, Homo sapiens
tctatattcatgaaatggcatattgtgtttaataatgcttattgagttattttttagtattcttatatttttgagtaataatcactcataatttttagtgtcctaaactgaatgttgcctttgacatctattatagtgccaattatttggtaagatttttttattaaggtaaaaagtaagattatatcatatataatagataacaatgaagaggagaaatggaaatctcaaaattggaagtttgtattttgatgtcttctatagaatataggcttcctagtttggcatggttagataactttggagaatccatattgttttttaacatatttgctttcttttcctctgtatatagtaatatgtatggttattttgctcatgtgatgtaatgatactgtctgtttattgtgaaactttttttttgtagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactgaggaattgagttcttctcagactttatcacatgatggaggattcttcaatagactggaagatgatgttcataaaattcttattagagaaaaacgaagagaacagcttacagaatataatggaacagataattgtacagctcatgaacacaaccaggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288581 - DNA, 1287 bp, Homo sapiens
tctatattcatgaaatggcatattgtgtttaataatgcttattgagttattttttagtattcttatatttttgagtaataatcactcataatttttagtgtcctaaactgaatgttgcctttgacatctattatagtgccaattatttggtaagatttttttattaaggtaaaaagtaagattatatcatatataatagataacaatgaagaggagaaatggaaatctcaaaattggaagtttgtattttgatgtcttctatagaatataggcttcctagtttggcatggttagataactttggagaatccatattgttttttaacatatttgctttcttttcctctgtatatagtaatatgtatggttattttgctcatgtgatgtaatgatactgtctgtttattgtgaaactttttttttgtagctgacatctgaaatgtttgaagcagatcttgagaaggcattgttactaagtaaactagaatatgaagagcacaaaaaggagtatgaagatgctgaaaatacttcaactcagtccaaagttatgaataaaaaagataaaagaaagaatcatcagggaaaagacagacctctcacagtatcactaaaagattttcattcggaagatcacattagtaaaaagactggaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288582 - DNA, 690 bp, Homo sapiens
cctaatctccatctattctttctccacgcgcctccctcaatatccccttctcagaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288583 - DNA, 705 bp, Homo sapiens
  misc_feature (10)..(10): n is a, c, g, or t
  misc_feature (19)..(19): n is a, c, g, or t
  misc_feature (50)..(52): n is a, c, g, or t
tttagggaanaaaaaaggnaggaaatttgataattggtaatttattatgnnnaaatggattctagtaagaagtggttctgaaagatggaagaattgaaagactaaagttagagcttgaaaggaaagatgctgaaatccagaagctgaaaaatgtaatcactcaatgggaggcaaagtataaggaagtaaaggcaagaaatgcacaattattgaaaatgcttcaggaaggtgaaatgaaagataaggcagaaatacttctgcaagttgatgaatcacaaagtatcaagaatgagctcactattcaggtgacttcacttcatgctgcattagaacaagaaagatctaaagtgaaagtattacaagcagagttagccaaataccagggtggcagaaaagggaaaagaaactctgaatccgaccagtgtaggtgattacattagcctttgaagtcaacacaaagtttaaaacttccaggattttgcaaagttgtatatatttaatgctgtgcaactgctaaactatgcagtttttgttgaaggaactaaaagcaactagctccctaatggtctataattttatttcttttggcttaaagtgaaaaagaagaaatagagaattccagcagaattcagtggttgtctactatccatacttcttatcactttagtttttcatcagtcaataaaattaatttactcttccact

SEQ ID NO: 288584 - DNA, 2302 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagcttcagttgtggagggccaaaagggtatcattcttcgagctattcaagaaatatttcaaagcatctctgaacatcctagcattgactttaatgtgaaagtatcttatatagaagtgtacaaggaagacctaagagatcttctagaattggagacatccatgaaagatcttcacatccgaaaagatgaaaaaggaaacacagtgtgtgcttgctgctgatgaagtagtatttaatcagaaggaactggaggttaaggaactgaagaatcaagtgcagatgatggtacaggaaaacaaagggcatgctgtatctttgaaagaagcgcaaaaagtgaatagactgcaggatctcattctgttgctcaggctggtgtgcgctggcacaatcacagctcactgcagtctcgaccttccaggctcaagtgatcctcccgcctcagcctcctaactgtgaccacaggtgcatgccaccgcgcccggctaattttctgatttttttgtggagacggggtctcactgtgttgctcaagctggtctcgaactcctgggctcagtgatcctaccacctcagcttcccaaagtgctgagattgattacagaatgaaaaaataatagaacaacaacttcttgtggatcaactgagtgaagaactaacaaaacttaacctgtcagtgacttcttcagctaaagaaaattgtggagacgggccagatgccaggatccctgaaaagagaccatatactgtaccatttgatactcatttggggcattatatttatatcccatcaagacaagattccaggagggggaatcacttgcaaggtccacacaagtccgcctatgtactctctggatcgaatatttgctggatttcgaacacaaagtcagatgctgttggatcacgtagaagaacgagatgaggtcctccactgccaattttctgataacagtgatgatgaagaatcagaaggccaagagaaatctggaactagatgtagaagtcgttcatggattcagaagccagactctgttcccttgttgaattgagtgatactcaggatgaaacacaaaagtcagattcggagaatgaagatttaaagattgattgtctccaggagagtcaagaattgaatttgcaaaaattaaagaattcagaacgcatacttactgaagccaaacaaaaaatgagagaacttacagttaacatcaagatgaaggaagatctgattaaagaattaataaaaacaggtaacgatgccaagtctgtaagcaagcagtatactttgaaagtaacaaagctagagcatgatgcagaacaggcaaaagtcgaactaactgaaacacaaaagcagctacaggagctggaaaacaaagatctttctgatgttgcaatgaaggtaaaattacagaaagagtttcgtaaaaaggtggatgctgcaaagctgagagttcaggtcttacagaagaagcaacaagatagtaagaaactggcatcactgtcaatccaaaatgagaaacgtgctaatgaactagagcagagtgtagatcacatgaaatatcaaaagatacagctacaaagaaaactacgagaagaaaatgaaaaaaggaagcaactggatgcagtaattaagcgggaccagcaaaaaatcaaagtaatattgtcatacattcctgctaagtataatatgaaatgttaaacggctcagagctaacgaatccatggtcttcattcagttggcttgtgaagtatctatccttgacttgcccttcactgctgtccttattcactttaaagctttgttcatctacatagtaaaacctatttattgaattttgaaaaatatc

SEQ ID NO: 288585 - DNA, 2298 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagcttcagttgtggagggccaaaagggtatcattcttcgagctattcaagaaatatttcaaagcatctctgaacatcctagcattgactttaatgtgaaagtatcttatatagaagtgtacaaggaagacctaagagatcttctagaattggagacatccatgaaagatcttcacatccgaaaagatgaaaaaggaaacacagtgtgtgcttgctgctgatgaagtagtatttaatcagaaggaactggaggttaaggaactgaagaatcaagtgcagatgatggtacaggaaaacaaagggcatgctgtatctttgaaagaagcgcaaaaagtgaatagactgcaggatctcattctgttgctcaggctggtgtgcgctggcacaatcacagctcactgcagtctcgaccttccaggctcaagtgatcctcccgcctcagcctcctaactgtgaccacaggtgcatgccaccgcgcccggctaattttctgatttttttgtggagacggggtctcactgtgttgctcaagctggtctcgaactcctgggctcagtgatcctaccacctcagcttcccaaagtgctgagattgattacagaatgaaaaaataatagaacaacaacttcttgtggatcaactgagtgaagaactaacaaaacttaacctgtcagtgacttcttcagctaaagaaaattgtggagacgggccagatgccaggatccctgaaaagagaccatatactgtaccatttgatactcatttggggcattatatttatatcccatcaagacaagattccaggagggggaatcacttgcaaggtccacacaagtccgcctatgtactctctggatcgaatatttgctggatttcgaacacaaagtcagatgctgttggatcacgtagaagaacgagatgaggtcctccactgccaattttctgataacagtgatgatgaagaatcagaaggccaagagaaatctggaactagatgtagaagtcgttcatggattcagaagccagactctgttcccttgttgaattgagtgatactcaggatgaaacacaaaagtcagattcggagaatgaagatttaaagattgattgtctccaggagagtcaagaattgaatttgcaaaaattaaagaattcagaacgcatacttactgaagccaaacaaaaaatgagagaacttacagttaacatcaagatgaaggaagatctgattaaagaattaataaaaacaggtaacgatgccaagtctgtaagcaagcagtatactttgaaagtaacaaagctagagcatgatgcagaacaggcaaaagtcgaactaactgaaacacaaaagcagctacaggagctggaaaacaaagatctttctgatgttgcaatgaaggtaaaattacagaaagagtttcgtaaaaaggtggatgctgcaaagctgagagttcaggtcttacagaagaagcaacaagatagtaagaaactggcatcactgtcaatccaaaatgagaaacgtgctaatgaactagagcagagtgtagatcacatgaaatatcaaaagatacagctacaaagaaaactacgagaagaaaatgaaaaaaggaagcaactggatgcagtaattaagcgggaccagcaaaaaatcaaacaaaaagaatgtttccagctgctacatttaagagagagctggccgagcacggtggctcatgcctgtaatcgcagcactttgggaggctgatgcaggcggatcacgaagtcaggagatcgagaccatcctggctaacacggtgaaaccctgtctctactaaaaatacaaaaacaaaattagccaggtgtg

SEQ ID NO: 288586 - DNA, 1895 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagcttcagttgtggagggccaaaagggtatcattcttcgagctattcaagaaatatttcaaagcatctctgaacatcctagcattgactttaatgtgaaagtatcttatatagaagtgtacaaggaagacctaagagatcttctagaattggagacatccatgaaagatcttcacatccgaaaagatgaaaaaggaaacacagtgtgtgcttgctgctgatgaagtagtatttaatcagaaggaactggaggttaaggaactgaagaatcaagtgcagatgatggtacaggaaaacaaagggcatgctgtatctttgaaagaagcgcaaaaagtgaatagactgcaggatctcattctgttgctcaggctggtgtgcgctggcacaatcacagctcactgcagtctcgaccttccaggctcaagtgatcctcccgcctcagcctcctaactgtgaccacaggtgcatgccaccgcgcccggctaattttctgatttttttgtggagacggggtctcactgtgttgctcaagctggtctcgaactcctgggctcagtgatcctaccacctcagcttcccaaagtgctgagattgattacagaatgaaaaaataatagaacaacaacttcttgtggatcaactgagtgaagaactaacaaaacttaacctgtcagtgacttcttcagctaaagaaaattgtggagacgggccagatgccaggatccctgaaaagagaccatatactgtaccatttgatactcatttggggcattatatttatatcccatcaagacaagattccaggagggggaatcacttgcaaggtccacacaagtccgcctatgtactctctggatcgaatatttgctggatttcgaacacaaagtcagatgctgttggatcacgtagaagaacgagatgaggtcctccactgccaattttctgataacagtgatgatgaagaatcagaaggccaagagaaatctggaactagatgtagaagtcgttcatggattcagaagccagactctgttcccttgttgaattgagtgatactcaggatgaaacacaaaagtcagattcggagaatgaaggtacatagatcttcttaaataatgtagacctaatggttataggacacttatctttttcctcagttgataatttaagaaacatccaggaattctcaaagaccagaatttggtacaaatggtttcctagttgatagaacttcttttatgttctctgttttacctcttttactccttaataaaaaaagattttctatcaattaattatggctagagatataggctaactccctcagaataaggatttttatattcagacctgaattgatatgctttgtattcctgatgatgttaaaatacagtataaataattgtactaggtgtctactccttcactgggacttgtgcc

SEQ ID NO: 288587 - DNA, 1738 bp, Homo sapiens
agcgggaggctctcacgccgcctcctccgcccgggcttccctccaccctccgcccgcccgcctgctctcagccgcgctctccccgcccctcaccgcagcctgcagccgcgctcacctccgcggtccgccccggcgccccgggacccgttagtgcccagcctgcgggccgaccgcgaccaccgcccggcgcgagcctgcccccagctctgccgacacttgacccagaccagtcccaacgcccagtgcggccgcccggggagccgcgggagaggcggcggcggggggaggagggagaggagggccgagccggcggcacgggaggcccggttttgaagccgcttctctgcccgagttaggtttcgcccagcgcaatttctttctctatgtactttgcgaataagtttcggagcatcggttaacagcctatgggtgaaatttggctttcattcatgaatgagcttcagttgtggagggccaaaagggtatcattcttcgagctattcaagaaatatttcaaagcatctctgaacatcctagcattgactttaatgtgaaagtatcttatatagaagtgtacaaggaagacctaagagatcttctagaattggagacatccatgaaagatcttcacatccgaaaagatgaaaaaggaaacacagtgtgtgcttgctgctgatgaagtagtatttaatcagaaggaactggaggttaaggaactgaagaatcaagtgcagatgatggtacaggaaaacaaagggcatgctgtatctttgaaagaagcgcaaaaagtgaatagactgcaggatctcattctgttgctcaggctggtgtgcgctggcacaatcacagctcactgcagtctcgaccttccaggctcaagtgatcctcccgcctcagcctcctaactgtgaccacaggtgcatgccaccgcgcccggctaattttctgatttttttgtggagacggggtctcactgtgttgctcaagctggtctcgaactcctgggctcagtgatcctaccacctcagcttcccaaagtgctgagattgattacagaatgaaaaaataatagaacaacaacttcttgtggatcaactgagtgaagaactaacaaaacttaacctgtcagtgacttcttcagctaaagaaaattgtggagacgggccagatgccaggatccctgaaaagagaccatatactgtaccatttgatactcatttggggcattatatttatatcccatcaagacaagattccaggagggggaatcacttgcaaggtccacacaagtccgcctatgtactctctggatcgaatatttgctggatttcgaacacaaagtcagatgctgttggatcacgtagaagaacgagatgaggtcctccactgccaattttctgataacagtgatgatgaagaatcagaaggccaagagaaatctggaactagatgtagaagtcgttcatggattcagaagccagactctgttcccttgttgaattgagtgatactcaggatgaaacacaaaagtcagattcggagaatgaagatttaaagattgattgtctccaggagagtcaagaattgaatttgcaaaaattaaagaattcagaacgcatacttactgaagccaaacaaaaaatgagagaacttacagttaacatcaagatgaaggaagatctgattaaagaattaataaaaacaggtaatagtatcttgtgaaccagcttatatgaga

SEQ ID NO: 288588 - DNA, 539 bp, Homo sapiens
aaaaatggaaatgtatgatagtaagcaattgtttgtgaacctgtcaaaaataaatgaaaatctagggaaaatttcttcttttaccatcaaatgaaaagattaagtttagttgaggattgtgagagattcagtttttcattttgaaatattccatatgatctcaggtcttacagaagaagcaacaagatagtaagaaactggcatcactgtcaatccaaaatgagaaacgtgctaatgaactagagcagagtgtagatcacatgaaatatcaaaagatacagctacaaagaaaactacgagaagaaaatgaaaaaaggaagcaactggatgcagtaattaagcgggaccagcaaaaaatcaaagtaatattgtcatacattcctgctaagtataatatgaaatgttaaacggctcagagctaacgaatccatggtcttcattcagttggcttgtgaagtatctatccttgacttgcccttcactgctgtccttattcactttaaagctttgttcatctacatagtaaaacctatttattg

SEQ ID NO: 288589 - DNA, 1472 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaa

SEQ ID NO: 288590 - DNA, 907 bp, Homo sapiens
agcgggtcagtcccctcgaagcccggttgccgtggaagccgcgtggggcgccttcctcagctcttcagttgagggtaccgggggatcaagggctcgggggctcacttccaccttgaagctactaggtatatggttcattagtgaatggatggccactggaaaaagcacagctttccagctggtggaactgggcccaggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagtatgtataattcagtaacatgatttatcagaatttcagtgttagatctgaagcccattgaagagctttgatttctacagtgcctggtattgttgtattacattattttatagttaacattaattcatgttattgtaattccccttaaccctagttcttactgctaacactgagtctactgt

SEQ ID NO: 288591 - DNA, 491 bp, Homo sapiens
  misc_feature (26)..(26): n is a, c, g, or t
  misc_feature (370)..(370): n is a, c, g, or t
  misc_feature (372)..(372): n is a, c, g, or t
  misc_feature (382)..(382): n is a, c, g, or t
  misc_feature (438)..(438): n is a, c, g, or t
  misc_feature (443)..(443): n is a, c, g, or t
  misc_feature (447)..(447): n is a, c, g, or t
  misc_feature (452)..(452): n is a, c, g, or t
  misc_feature (462)..(462): n is a, c, g, or t
  misc_feature (486)..(486): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagtgcggcncntgcgttgggngcagcacatgcgttaggagcggcacatagttgggatcggcacatggaaacctaacntaagngtcnggacntactagttangtagcgggagaaagcccagttttncccct

SEQ ID NO: 288592 - DNA, 2200 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaac

SEQ ID NO: 288593 - DNA, 2330 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaaccgagaagaaaaatggttccctattcacttgaatttgcctttgtttggcaaaagaactcgagggggggcccggcacccaattcgcccttatgtgggtggtttacaattaactggccgcgttttaccacgcc

SEQ ID NO: 288594 - DNA, 1943 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagcccagcctccgggccacccagcctgtggaggttggtcaggtggtcacccatcttcttgataagcttcacttcctcatctaggaagtgagtctccaggaagtcacagagatgggggtccgtgcgggcagaacccagggcatgaagatccaaaagggcctggttcagctttttctccagggccatggcagctttcatggcgtctggggttttaccccactcatcttcagctggcttcttgatgtcctggaagagagc

SEQ ID NO: 288595 - DNA, 2019 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaaaaaaaaaaaaaaaaaaaaaaaaaaaaaaaaaaaaaaaaaaaaaaagggggggcccccaaaaaaccccccggggggccccagatttgaaccgctcccgccgcgttttttggtgtaaaacaagggtggccccctaagagagaagacggcattattaatgaacagcagagaccgtgggccggcgggtttaaaacaagagtcgggagaagcgaggacaaaagtggtcgcaacactggagggacctctgcggcgagagaggagaacccactcatacatcagcggcgcggggggcaaccaatatattgtgcggcggaaacaaacatatctcccctcaaaggagaaaatatttttttaagacccctctcacagaggggggggaaataatatttacaatttttcaagagacgggggtgactaatacgtgtgggtggtacacccaccacacgcggcaattatttgactcctcggccgtcgtctgctaaaaaaattactcttgtgtgctacaagcgggagggatatacttattctcctcgccaaacacttttttctc

SEQ ID NO: 288596 - DNA, 1946 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacactgcagatgacaatctacaaagaacaagttacacagcaaaatatcagtccataaaatgaaatccttccttatttaggttagctcagtgattaaggatcttcttccatatcatctggattaggagccataatgaagtgctttgggtatacaaggttatgtgtgtatgcatgtatttcccagcgagcatcatcactttcatgtgtaatgtaacgttctccaatgcgagtttcaaattctctaaggtcaagccaagtctgatagtcctaggagaaaatgaaattgtaatgatgaaacaaaagaaacaaaatactgtcaacctggtttttgttttgtgtttttttttgttgttgtttagtgccctagtcaaataattgacaggcgctactcataagtatctactatgtactaagttctacttgtgatattttaaatgagcaatttaaagaaatttttcaaactcagagtctccaat

SEQ ID NO: 288597 - DNA, 1184 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagtatgtataattcagtaacatgatttatcagaatttcagtgttagatctgaagcccattgaagagctttgatttctacagtgcctggtattgttgtattacattattttatagttaacattaattcatgttattgtaattccccttaaccctagttcttactgctaacactgagtctactgt

SEQ ID NO: 288598 - DNA, 2197 bp, Homo sapiens
agcgggtcagtcccctcgaagcccggttgccgtggaagccgcgtggggcgccttcctcagctcttcagttgagggtaccgggggatcaagggctcgggggctcacttccaccttgaagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaac

SEQ ID NO: 288599 - DNA, 3040 bp, Homo sapiens
agcgggtcagtcccctcgaagcccggttgccgtggaagccgcgtggggcgccttcctcagctcttcagttgagggtaccgggggatcaagggctcgggggctcacttccaccttgaagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaaggtaattacctttatgtggattaatgaaagaattttgatcacaaccctcacagtattgatgggactgtaactttttacagcaatataatagattgagttactgctgccaagtcccttatccatagagagtagcctacttttttctagaaaagagcatcttaatagaaaataaagttgcctgacattaagtagtagtttatttcatgaagctttgtaaaatcccaaacaaaatgtaaatctcctttgtacttttgagtatttccctatagctagggttgtaccgatgacggagcagcccaaggcagctggggctgatggaagcagtgttagtaggtgggtttagttcagttatagagtcttttaaaaaatccttacttgcctaaagacaagcaaggtgtgggggaaaatccctgtactagtcaggaatactgactagtattgactagtttgagtcttgactcaaagccaaagtgggggtacgatcttgggtaagggatctcaagccattcctgcctcagccttctcaggctgagaagcccgattttatgaaatcaaattcccttccagctaacaactctgacttctaatttctttcaagccttgtgatgaataaaagctttaactgctatttcaggtatttccattttctgaccccatttatgtgtaaaataagaatagtaataattgttctatgttctgcagtgtaagttttccatgaagaggtagataattctgtggtagtgatgattatggaggaagtaggcattttttttacagttaatattcaaaagaattaattcctgtgaaatgtggaaacattaattgttttcctctttttaaatagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaac

SEQ ID NO: 288600 - DNA, 1987 bp, Homo sapiens
  misc_feature (26)..(26): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaac

SEQ ID NO: 288601 - DNA, 1988 bp, Homo sapiens
agcgggtcagtcccctcgaagcccggttgccgtggaagccgcgtggggcgccttcctcagctcttcagttgagggtaccgggggatcaagggctcgggggctcacttccaccttgaagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtgttcactcaacttggatctgtgctgaaaaattgtgacatttcagtacatctggtagagccttgtgatgaataaaagctttaactgctatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaac

SEQ ID NO: 288602 - DNA, 1822 bp, Homo sapiens
  misc_feature (1784)..(1784): n is a, c, g, or t
  misc_feature (1816)..(1816): n is a, c, g, or t
agcgggtcagtcccctcgaagcccggttgccgtggaagccgcgtggggcgccttcctcagctcttcagttgagggtaccgggggatcaagggctcgggggctcacttccaccttgaagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaaggtaattacctttatgtggattaatgaaagaattttgatcacaaccctcacagtattgatgggactgtaactttttacagcaatataatagattgagttactgctgccaagtcccttatccatagagagtagcctacttttttctagaaaagagcatcttaatagaaaataaagttgcctgacattaagtagtagtttatttcatgaagctttgtaaaatcccaaacaaaatgtaaatctcctttgtacttttgagtatttccctatagctagggttgtaccgatgacggagcagcccaaggcagctggggctgatggaagcagtgttagtaggtgggtttagttcagttatagagtcttttaaaaaatccttacttgcctaaagacaagcaaggtgtgggggaaaatccctgtactagtcaggaatactgactagtattgactagtttgagtcttgactcaaagccaaagtgggggtacgatcttgggtaagggatctcaagccattcctgcctcagccttctcaggctgagaagcccgattttatgaaatcaaattcccttccagctaacaactctgacttctaatttctttcaagccttgtgatgaataaaagctttaactgctatttcaggtatttccattttctgaccccatttatgtgtaaaataagaatagtaataattgttctatgttctgcagtgtaagttttccatgaagaggtagataattctgtggtagtgatgattatggaggaagtaggcattttttttacagttaatattcaaaagaattaattcctgtgaaatgtggaaacattaattgttttcctctttttaaatagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattctaatnataaagttcctgattagcacttcattatagtnctaata

SEQ ID NO: 288603 - DNA, 1884 bp, Homo sapiens
agcgggtcagtcccctcgaagcccggttgccgtggaagccgcgtggggcgccttcctcagctcttcagttgagggtaccgggggatcaagggctcgggggctcacttccaccttgaagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaaggtaattacctttatgtggattaatgaaagaattttgatcacaaccctcacagtattgatgggactgtaactttttacagcaatataatagattgagttactgctgccaagtcccttatccatagagagtagcctacttttttctagaaaagagcatcttaatagaaaataaagttgcctgacattaagtagtagtttatttcatgaagctttgtaaaatcccaaacaaaatgtaaatctcctttgtacttttgagtatttccctatagctagggttgtaccgatgacggagcagcccaaggcagctggggctgatggaagcagtgttagtaggtgggtttagttcagttatagagtcttttaaaaaatccttacttgcctaaagacaagcaaggtgtgggggaaaatccctgtactagtcaggaatactgactagtattgactagtttgagtcttgactcaaagccaaagtgggggtacgatcttgggtaagggatctcaagccattcctgcctcagccttctcaggctgagaagcccgattttatgaaatcaaattcccttccagctaacaactctgacttctaatttctttcaagccttgtgatgaataaaagctttaactgctatttcaggtatttccattttctgaccccatttatgtgtaaaataagaatagtaataattgttctatgttctgcagtgtaagttttccatgaagaggtagataattctgtggtagtgatgattatggaggaagtaggcattttttttacagttaatattcaaaagaattaattcctgtgaaatgtggaaacattaattgttttcctctttttaaatagggtacagcttttatcttgcacatgaattttttgatgttcttcctgtgcataaatttcaggtattgaggggggaaaaaagtcatgtctataattgaatacaaaaggcattgtgttgccaatgtttatggtatttattcagtatacaaattttacttgttgaggttatttttaactattatttggaattttggtacacaaataattcaaaagcaaaaaatgaaatattaatgagaattgttagttctcctgggataattattaagaattcttaattcttctgatttgaagaagtaagggaatgaaaaatggtaagatggtaactggctgtggtgcaatgaaggatttacttaagcaaa

SEQ ID NO: 288604 - DNA, 932 bp, Homo sapiens
  misc_feature (26)..(26): n is a, c, g, or t
  misc_feature (796)..(796): n is a, c, g, or t
  misc_feature (870)..(870): n is a, c, g, or t
  misc_feature (886)..(886): n is a, c, g, or t
  misc_feature (905)..(905): n is a, c, g, or t
  misc_feature (910)..(910): n is a, c, g, or t
tgtcttctcccggaaatggtctaagncccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagagaaaacaccacagggatggcgagaagtatttgttgacattgatccacaggtttctgataaactgaggtttgttttggcaccttctgccaccccagcagaagccttcatacaacatgaagaaagtagcagggatggatgtggagctgacagttgaagaaagaaacctcctatctgttgcatataagaatgtgattggagctagaagagcctcctggagaatatcagcagctggtgctgcaccagcaggaggtctgcccctccantgtgtgctccagtgaggagaagaagtgcaagcaaggaagaagaatcgaggagtctgatgatgacatgggtggcnttgactaaccttttanactgtcataagtgactttnaaaanaactaaaaatcaactaatacac

SEQ ID NO: 288605 - DNA, 2917 bp, Homo sapiens
cgcgggccagcggcctccggtccccaggtggcgctgtgggctcgcggaggcggccgcggcaccagggagcgtcgtctccctggtgcgcatgctcgcccccgctgcgggctagctgttgtgttttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288606 - DNA, 424 bp, Homo sapiens
ggttgttgaagagttgtttaaaggtgcacagatattgtatggaatgatgacacaaaggtagttacttagtatatcctgatttccagtatttgtttacttttttttaaaaaaattatgctttaaaaggtactcttcattttcttgtgttgtacagatttcaaatgaagtttttctacatatcacagctggcttactggcttcatgcttttcctgaactctacttccagaaaaccaaaaaagtaagctgggattttgtagtgttaaaaaatgtcttgtcatttttttttttgaaaaatttttctaaaattaagtattttcttacatgtttgcccttcctccattcttcttacctcaactcttaccccatcattctcccaccaaccctctttccacaaagcctaaaatccttaagcatttcttgaaa

SEQ ID NO: 288607 - DNA, 293 bp, Homo sapiens
agccctttctttgttaaggaccatggtcatgtcactattaatcagaattcattcttgttattctctttaggaccttaggcaaatgcataaaatagatgaaaatatgtctttgacagtcccactgccgtaagaaaaaaaaagctgtgtacctttttttaatgtttctattctaatcttttcaacatctttgtaagcttgagacaactgattttaacataacttaatttggtactcgcttcttttcccttcttttcactcatactttctcctttttatgactccatcttctctat

SEQ ID NO: 288608 - DNA, 2801 bp, Homo sapiens
cgcgggccagcggcctccggtccccaggtggcgctgtgggctcgcggaggcggccgcggcaccagggagcgtcgtctccctggtgcgcatgctcgcccccgctgcgggctagctgttgtgttttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcatttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288609 - DNA, 2652 bp, Homo sapiens
ggcgggtgggcggacttggggggactgccagcctcggccgcggtgagcgtcagccccgcgagggccggggaaggccgaggcccggcccccgggtctgaggagtgccggcctggagaccacaggccccgagtgacaggggagcccccggtagctccgagattgggataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288610 - DNA, 2236 bp, Homo sapiens
acatccatttctgtatgcaacttttgtatttttggagagagagtcagtcacacatacgctactccatcatagcttgaagaaggccattactattagccaggtgtggtggcacatgcctgtagtcccagctatttgggaggctgaggtccccgggagcatcactggtccccgggagttcaagactgcattgagccatgatcgtgccactacacagccttggtgacagagtgagaccctgtctcaaaaaacaacagtaacataaataaataaaaagaaggccataatacacgcctccacatagaaattatcctaaacaccaactttactatattgtaaacaaatatccccaaggacttcgctgtcaaatgtgaaaagtttctttatttctacagaaggtatttctcttgaatactatttttaaattcttgtgactttatagttttctgtgctgtcacttttttctgcttttaatagtagttttcttttaatttgctactttcagttcattgtgttaaaaatgttaccaggttttgtgattggttaaatactggtaagtaaatttcacctgagtgaattggattttacattttcttttctgaaggtatctttacatataaagattataacttgcatttatttataaaagagagtaacatggattcttttctttttgcagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288611 - DNA, 2182 bp, Homo sapiens
acatccatttctgtatgcaacttttgtatttttggagagagagtcagtcacacatacgctactccatcatagcttgaagaaggccattactattagccaggtgtggtggcacatgcctgtagtcccagctatttgggaggctgaggtccccgggagcatcactggtccccgggagttcaagactgcattgagccatgatcgtgccactacacagccttggtgacagagtgagaccctgtctcaaaaaacaacagtaacataaataaataaaaagaaggccataatacacgcctccacatagaaattatcctaaacaccaactttactatattgtaaacaaatatccccaaggacttcgctgtcaaatgtgaaaagtttctttatttctacagaaggtatttctcttgaatactatttttaaattcttgtgactttatagttttctgtgctgtcacttttttctgcttttaatagtagttttcttttaatttgctactttcagttcattgtgttaaaaatgttaccaggttttgtgattggttaaatactggtaagtaaatttcacctgagtgaattggattttacattttcttttctgaaggtatctttacatataaagattataacttgcatttatttataaaagagagtaacatggattcttttctttttgcagaaaatggtgtgaatggaacattaacttcaaatgtagcagactctccccggaataaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288612 - DNA, 2138 bp, Homo sapiens
  misc_feature (2137)..(2137): n is a, c, g, or t
cgcgggccagcggcctccggtccccaggtggcgctgtgggctcgcggaggcggccgcggcaccagggagcgtcgtctccctggtgcgcatgctcgcccccgctgcgggctagctgttgtgttttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaactatttggtcccgtggttctactacttaacagtttaagttggagaactgggttctgaggaagatagacaaagactggttaagtggaattgaagattcttgcatttcttgtttttttttcttcnt

SEQ ID NO: 288613 - DNA, 1950 bp, Homo sapiens
cgcgggccagcggcctccggtccccaggtggcgctgtgggctcgcggaggcggccgcggcaccagggagcgtcgtctccctggtgcgcatgctcgcccccgctgcgggctagctgttgtgttttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctcttaaaaaaaaaaaaaaaaaaaaaaaaaaaaaaaaaagggggggggggcaaaaaaattcccccggggggccccaagtttggggtccccgcgtgttcttgttgtgccaaccaggtggcccccatatgggggagccggtatataaaagcagagacgggggccgtggttaaacaaaccgtcgcggacgcggggaaacacgcgtcaacgccggggacaacctggtgggaaaaggaacccccttcacgctcggggggggggggacacaaggcgggccacaaacttcccatagagaaaattaaaagggcccaaaggggaaaacttaatactctaagggtgttcacgggggttacacaaccggccaaataacccggcgccgtgaaaactggcccacaggaggatattttgacaacatttttcccg

SEQ ID NO: 288614 - DNA, 452 bp, Homo sapiens
aaatggaacgaacactgaaaagaacaatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288615 - DNA, 610 bp, Homo sapiens
ggctcggggcgggtgggcggacttggggggactgccagcctcggccgcggtgagcgtcagccccgcgagggccggggaaggccgaggcccggcccccgggtctgaggagtgccggcctggagaccacaggccccgagtgacaggggagcccccggtagctccgagattggggtgagcgagaaaccggagtcaggcatctgctttcgacttgaagggcggtggccgccgggcaccggcgcagtggaggcgcgccagattgttttcatttttgtcttttaaactgatattattaccagttaacgaactttttgccctgacgctttaaagaaacaaggtctgatggataaatcgaggttctgaacagcggtgccaaggaatcgagtaattttgtttcttgaagtaggagaggatgggaatgtcaggagtgtgtaaattctcttcccacgtatctagtattttgatgacttatttaacagctgttgaatgtggatgataaactttgcaaggtgaacgagtaacatcctacgtttttcccctcgctccccaatacacacgctcattcctttgcttttttccctttttaatttttctctggagcctttatgtctca

SEQ ID NO: 288616 - DNA, 405 bp, Homo sapiens
tgctcacaggttaatttttatatcttctttcttaggaaaactacatctcagacccaactatcttatggagggcttatccccataacctgatgacgtaagtcatttttagcagccctttctttgttaaggaccatggtcatgtcactattaatcagaattcattcttgttattctctttaggaccttaggcaaatgcataaaatagatgaaaatatgtctttgacagtcccactgccgtaagaaaaaaaaagctgtgtacctttttttaatgtttctattctaatcttttcaacatctttgtaagcttgagacaactgattttaacataacttaatttggtactcgcttcttttcccttcttttcactcatactttctcctttttatgactccatcttctctatat

SEQ ID NO: 288617 - DNA, 2243 bp, Homo sapiens
tggcggcgtctgaggatccccttagtctgaccacccttcgcgtcgacccaccatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288618 - DNA, 3151 bp, Homo sapiens
cgcgggccagcggcctccggtccccaggtggcgctgtgggctcgcggaggcggccgcggcaccagggagcgtcgtctccctggtgcgcatgctcgcccccgctgcgggctagctgttgtgttttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaagttgtatcctggatgtttctgtcattgttggtgattaggctattttggtatataacctcattaaaatgtaccatatttaaaacacttcatagacattcagaataacccttttcaaaattgtgttctgcaaataaacagatttgttccacagaatattggtgaggactactggggggatagatggtcataaccaaataaatctgggaatcactggattaaactaacctaaa

SEQ ID NO: 288619 - DNA, 1824 bp, Homo sapiens
gatcgatcgagctcggtcctttgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatcgctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttc

SEQ ID NO: 288620 - DNA, 1061 bp, Homo sapiens
cgcgggccagcggcctccggtccccaggtggcgctgtgggctcgcggaggcggccgcggcaccagggagcgtcgtctccctggtgcgcatgctcgcccccgctgcgggctagctgttgtgttttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagtaagctgggattttgtagtgttaaaaaatgtcttgtcatttttttttttgaaaaatttttctaaaattaagtattttcttacatgtttgcccttcctccattcttcttacctcaactcttaccccatcattctcccaccaaccctctttccacaaagcctaaaatccttaagcatttcttgaaa

SEQ ID NO: 288621 - DNA, 3891 bp, Homo sapiens
ggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaa

SEQ ID NO: 288622 - DNA, 1049 bp, Homo sapiens
  misc_feature (899)..(899): n is a, c, g, or t
cgcgacgaggagccgggcgtccggggcgagcgggaggcagccgcactcgccctggcagccgcgagctgtgcggcctgggaccggccggaggtcgccagcgagcagccgccggctccattcattcgcgcggctccgcctcctttcccgggctcttccagcggctcccggggcgcgtctgagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaatgaactcaaagaccatgtctgggaatattggccctgccgtcttgtcccgaaatacgaaggcggaactggaggaacanccaggctagttgagaagcgggtacaaatgaggcttttaaagagcggtgtggcactctcgagggcggttaaacatcgttgtccctatcgcagggggccacgggccacaatggtatgacgtcggcgatgttatcgcccacgggagaaagccg

SEQ ID NO: 288623 - DNA, 2397 bp, Homo sapiens
agctcacagcaagtccaggctagaggtagaaacgtgagagccccacggctggggaagattgccatgggattggagatgagctccaaggacagccctggcagtctggatggaagagcttgggaagatgctcagaaaccacaaagtgcctggtgcggtgggaggaaaaccagagtgtatgctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288624 - DNA, 2254 bp, Homo sapiens
gggagtaggaagcggccgcgatgtccttttgtgtcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288625 - DNA, 2158 bp, Homo sapiens
gctaggtagaggctgggtgttaatcggccgaggcggccgagggcggcgcccgccgtgtgcctgggaccggcatgctggggcaggagggcagccgcgtgtcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288626 - DNA, 2307 bp, Homo sapiens
ctggtactgccccggcggtacggatctggtagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggtcgcgaggaggtggagcggcgcccgccgtgtgcctgggaccggcatgctggggcaggagggcagccgcgtgtcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288627 - DNA, 2327 bp, Homo sapiens
gagaacttcctcctccttggctctccccacttacttcctgataacctggtagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggtcgcgaggaggtggagcggcgcccgccgtgtgcctgggaccggcatgctggggcaggagggcagccgcgtgtcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288628 - DNA, 1917 bp, Homo sapiens
gggagtaggaagcggccgcgatgtccttttgtgtcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccagggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288629 - DNA, 2192 bp, Homo sapiens
ggaacctggggacctgccagccaagatactcggtgggaggaaaaccagagtgtatgctgtcctagaagcaaaagaagaaagtgtttcagtgtttctaggagcaggaagtgatcaacagccttagatcctccttttaggccaagtaacatgaggactaagaattgaccactggatttagcaatgcagaggtccttgtggcccttgatgtcggcagatgagggcagtgtggtccagagatgaggcttggggctgagatgcagccccgctgcctggtccagctcctccctcatccaggcagggctcccccgcccagcagccactcccctccctgcctgctcatggccccctgctctccctttcctccccatacccccagacctgtgcttgcccggggagagtcagggctctcctgtcagctgggtcccctcccagccccgggaggccgccactggagccctgcctcttcctggcagggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288630 - DNA, 555 bp, Homo sapiens
gcatccggtccatccccagtggtgtaagacgggacgcggcgcggtggggcggcgcggcccgaggaggcggcggaggaggggccgcccgcggcccccggctcactccggcactccgggccgctcggcccccatgcctgcccgaccgcgctgccggagccccaggtccgggggcggatgggagcgctgccgcgggggtgggcgggcggggcgcgggggccatgtgcgagcgcggcagggaggcgggcggggcgggctgcatgcggggtccgactctggggccagtccgggccacggttgggacccagtcgagggtcggactggtcagggttcaggcgggatccggcgtccgagtcctggtgggccggcctggggcaggatctggctctggctgcgggtcctgactcgggtcagggttgggcctccgatccagcccgctccggggcagggttcaatcccgcatttgccgaagtccctggggctggccggggtggaagacggggagggctctatgtctgggaaggggctctgaagaccacgtgggggcgctcgaagggg

SEQ ID NO: 288631 - DNA, 321 bp, Homo sapiens
cgggctttccctgggagacagttagcgctcttccctggagggaagtcactggacagctgctactgaggaaggccacagggggagccactgtgggaagatgcttgacccctgaggcctgacagattcgagtgctcctgactcttgtcctctaattgtcacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaa

SEQ ID NO: 288632 - DNA, 2083 bp, Homo sapiens
gggagtaggaagcggccgcgatgtccttttgtgtcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288633 - DNA, 1823 bp, Homo sapiens
gggagtaggaagcggccgcgatgtccttttgtgtcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctc

SEQ ID NO: 288634 - DNA, 1136 bp, Homo sapiens
ggcacgaggatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcagctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 288635 - DNA, 767 bp, Homo sapiens
cacctctaggaggagggtgaagcttcttgtcttccagacattcccgaggaaaacttacacgaggagtctgtcaaggagtgccaccctttggacaaagaaaacgagactgacaacgaagtctgaaggagaaaggcaagtatctttctgctggactggccctcaagacttagcacaactgccttcaccagtgagcacaaagccacatttcaaaggaaactgacaaattatccccagctgccagaagaaggttagttttctgtgtgttcagtgtcccccttctctgataaccaacaggttaactttctaaagggaactgacaaaagcagaaattgtccttttacccaaatgagttgtgattgttgatttttttaaagatgtggatttgtaatattcctctccattcctactctaatttataccaggaaatagagtgtaagtgatcacaatggaacctctattgtttgcaagattcatattaatgcattctggttttttaagtgcttacaagatctaaattaatttttaaattagctagcatagtgtctttactcaatgagtagccatttaaaggctgaatgatgtcagccctggccatagagatttatgtgttgttatatttcatttgcatttttaaccatctttgtacatgtgttatgcctctagcacttatgctgtataacaggagagagtctaatgcctagcacagtacactacatatagtaggtgctcactaaatgccatttgaattgaaatgatccaaaagagtg

SEQ ID NO: 288636 - DNA, 1056 bp, Homo sapiens
  misc_feature (69)..(69): n is a, c, g, or t
ggccacgaaacaccactcccccttaataaaaaaaaaaaaaagccttttaggtggactgactctctcctnaacgccgaacagctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 288637 - DNA, 1173 bp, Homo sapiens
ggcacgaggatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcagctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataatgcctgatgcggccggcccacaatcccacgcaatcgcgatcagcaccaagcgctcg

SEQ ID NO: 288638 - DNA, 1065 bp, Homo sapiens
cacctctaggaggagggtgaagcttcttgtcttccagacattcccgaggaaaacttacacgaggagtctgtcaaggagtgccaccctttgctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 288639 - DNA, 1177 bp, Homo sapiens
gaggaaacagccctagctattcctgaggcccccattactgcctggtcaagggctttggggcacatactgcctgtgcgtccatcctcatgaactccaaatctccccgctactccacaggacaaagaaaacgagactgacaacgaagtctgaaggagaaaggcaagtatctttctgctggactggccctcaagacttagcacaactgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 288640 - DNA, 1064 bp, Homo sapiens
ggcacgaggatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 288641 - DNA, 927 bp, Homo sapiens
ctcttgtgtttttttgtgctctagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 288642 - DNA, 1999 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288643 - DNA, 3194 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttatttttttgtagagacagggcctccctgtgttgcccaggctgatgaactgtaatttttaacacacacagtgtagggaatgtgaaagactatcacagagtagaagaaaaaattattttcagggttagcaggtggattgtcccaagcagtcacactagaatctgtggactgaagccacatttgccagctccaggcttctaacacatctgaaactgtgtatgtagaacagctagctcaatgcctggcatatggtaagcacacagtaaattagcgccttcctcttctccatggttccttaaaactggcaacgctaaattctctctctcagtatcacggatataatttgtcccagcagctttaattcatttaaagcagttagatgttgttttataatatcttcagttttctctcaccaatgtgttttctaattgtttaaacacttgagtgtcaaacaattgccagccaccatactaaacacaacatacaaggatagataaataagacaccatctctgccctcaagccagtcaccatcatttactaagcacctgttttgtgctaagtactggggtaagccttggggatataaagattaataaattttgagcatacagtctagtaggaggagacaaataagtacataagtaccaggaagtattaggggtgctacagtagaagagtaaacactatgtac

SEQ ID NO: 288644 - DNA, 3187 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcaaaaaaaaaaaaaaaaaaaaaaaaaaaaaaaaaaaaaaaaaaaaaaaacaaaaaacaaaacacaacaaaagaaaaaaaaaaaaccagagaagagggaagcacaaacagaaaaaaagagagggggggcggggcgaggcggaggtagggggcgcgggcgccccacgagggcaggagggagggcgagggaaggggggcaaacaagaaaagaaaaacgaggagggcaaaaagccagaagaggaagagacaccgccacaaaaaaacaaacgacgagcggcggggaggagaaaaacaaacagagaaaagacaaaacagagaggaagggagagaggaagaagagaaaaaacaaaagacagaacaaaaacatgaagaagagcggattcacaaagagcacacgcgaacacaaagaaatagaaacaaacacgacaccgaccacatcagagagagcgagaaaacaaacacacaaaaaacgacaaagccgaggccgacgaggagacgagacaaaccagaaacacaaccgaaaagcaaaaaagaaaacaaaaagagacacaacaaagacaagaaaaggagagaaagaagggagaacacgagagccacagagaaagggagagacgagaccaagggagaggagacaaggcagagggaagagacaagagagagagagggagaagaacgaggaggcgagacgaaaggagaggggagagaagagggccgacgcgagaggtaggaaaaagggaagaggaaggagggcaagcaggaagggaggagagaagagagcgcaagggatagaaacggacgaagagacagcgaggaggaaaagaagcgaagagagagagggcaagcgaggacggggggggaaagcaggggagagggaagaagcggggcagggacaggaccgacaagagaggagaggcagagaagaagagaga

SEQ ID NO: 288645 - DNA, 1909 bp, Homo sapiens
atctctctctctctctctctctctctctctctctctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288646 - DNA, 1847 bp, Homo sapiens
gctggtacggcccggaatgtagggatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288647 - DNA, 2924 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattaaaaaaaaaaaaaaaaaaaaaaaaaaaaaaaaaaaaaaaaaaaaaaaacaaaaaacaaaacacaacaaaagaaaaaaaaaaaaccagagaagagggaagcacaaacagaaaaaaagagagggggggcggggcgaggcggaggtagggggcgcgggcgccccacgagggcaggagggagggcgagggaaggggggcaaacaagaaaagaaaaacgaggagggcaaaaagccagaagaggaagagacaccgccacaaaaaaacaaacgacgagcggcggggaggagaaaaacaaacagagaaaagacaaaacagagaggaagggagagaggaagaagagaaaaaacaaaagacagaacaaaaacatgaagaagagcggattcacaaagagcacacgcgaacacaaagaaatagaaacaaacacgacaccgaccacatcagagagagcgagaaaacaaacacacaaaaaacgacaaagccgaggccgacgaggagacgagacaaaccagaaacacaaccgaaaagcaaaaaagaaaacaaaaagagacacaacaaagacaagaaaaggagagaaagaagggagaacacgagagccacagagaaagggagagacgagaccaagggagaggagacaaggcagagggaagagacaagagagagagagggagaagaacgaggaggcgagacgaaaggagaggggagagaagagggccgacgcgagaggtaggaaaaagggaagaggaaggagggcaagcaggaagggaggagagaagagagcgcaagggatagaaacggacgaagagacagcgaggaggaaaagaagcgaagagagagagggcaagcgaggacggggggggaaagcaggggagagggaagaagcggggcagggacaggaccgacaagagaggagaggcagagaagaagagaga

SEQ ID NO: 288648 - DNA, 3000 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttatttttttgtagagacagggcctccctgtgttgcccaggctgatgaactgtaatttttaacacacacagtgtagggaatgtgaaagactatcacagagtagaagaaaaaattattttcagggttagcaggtggattgtcccaagcagtcacactagaatctgtggactgaagccacatttgccagctccaggcttctaacacatctgaaactgtgtatgtagaacagctagctcaatgcctggcatatggtaagcacacagtaaattagcgccttcctcttctccatggttccttaaaactggcaacgctaaattctctctctcagtatcacggatataatttgtcccagcagctttaattcatttaaagcagttagatgttgttttataatatcttcagttttctctcaccaatgtgttttctaattgtttaaacacttgagtgtcaaacaattgccagccaccatactaaacacaacatacaaggatagataaataagacaccatctctgccctcaagccagtcaccatcatttactaagcacctgttttgtgctaagtactggggtaagccttggggatataaagattaataaattttgagcatacagtctagtaggaggagacaaataagtacataagtaccaggaagtattaggggtgctacagtagaagagtaaacactatgtac

SEQ ID NO: 288649 - DNA, 1886 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccaatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288650 - DNA, 1750 bp, Homo sapiens
gctgtctgaacgtggcggcactgactggaccaagagaccacgtccgaaacgggaacctgtgtaaaggaagtgtagagctaggagccaagcgccttggaagccctttccgaggatggcaaaggatctgggaatgcttctccaaagatatgtggatggacgaaatagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctgtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288651 - DNA, 1222 bp, Homo sapiens
agatttgggtctcgctgtgctagggatgctaatgccttatggaggttgatgacatacattccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288652 - DNA, 1243 bp, Homo sapiens
  misc_feature (1213)..(1213): n is a, c, g, or t
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtggatcatctgccagcagagtgagatactgatcaagactttattagagangttatagccaacaggtaggataagaagggc

SEQ ID NO: 288653 - DNA, 2130 bp, Homo sapiens
tctataagatctcgtgtcgccagccaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttatttttttgtagagacagggcctccctgtgttgcccaggctgatgaactgtaatttttaacacacacagtgtagggaatgtgaaagactatcacagagtagaagaaaaaattattttcagggttagcaggtggattgtcccaagcagtcacactagaatctgtggactgaagccacatttgccagctccaggcttctaacacatctgaaactgtgtatgtagaacagctagctcaatgcctggcatatggtaagcacacagtaaattagcgccttcctcttctccatggttccttaaaactggcaacgctaaattctctctctcagtatcacggatataatttgtcccagcagctttaattcatttaaagcagttagatgttgttttataatatcttcagttttctctcaccaatgtgttttctaattgtttaaacacttgagtgtcaaacaattgccagccaccatactaaacacaacatacaaggatagataaataagacaccatctctgccctcaagccagtcaccatcatttactaagcacctgttttgtgctaagtactggggtaagccttggggatataaagattaataaattttgagcatacagtctagtaggaggagacaaataagtacataagtaccaggaagtattaggggtgctacagtagaagagtaaacactatgtac

SEQ ID NO: 288654 - DNA, 2126 bp, Homo sapiens
ctgcctcagcctcccaaagtgttcggattacaggccttagccactgtgcccggcctaaaacatctttatttcattaaagtcaagagttctaagttcccaaacccatctgaagtgtcctttgctccatagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttatttttttgtagagacagggcctccctgtgttgcccaggctgatgaactgtaatttttaacacacacagtgtagggaatgtgaaagactatcacagagtagaagaaaaaattattttcagggttagcaggtggattgtcccaagcagtcacactagaatctgtggactgaagccacatttgccagctccaggcttctaacacatctgaaactgtgtatgtagaacagctagctcaatgcctggcatatggtaagcacacagtaaattagcgccttcctcttctccatggttccttaaaactggcaacgctaaattctctctctcagtatcacggatataatttgtcccagcagctttaattcatttaaagcagttagatgttgttttataatatcttcagttttctctcaccaatgtgttttctaattgtttaaacacttgagtgtcaaacaattgccagccaccatactaaacacaacatacaaggatagataaataagacaccatctctgccctcaagccagtcaccatcatttactaagcacctgttttgtgctaagtactggggtaagccttggggatataaagattaataaattttgagcatacagtctagtaggaggagacaaataagtacataagtaccaggaagtattaggggtgctacagtagaagagtaaacactatgtac

SEQ ID NO: 288655 - DNA, 1922 bp, Homo sapiens
caggaattcaagaccagcctggaaaatatagtgagaccatgtctccaccacccccaaaagattaaaaaattagcggagcatggtggtgcatgcctgtagttccggctacttgggggactgaggtgggaggattgcttgagccggaggtggaagttgcagtgagctgatatcacgccaccgcactccatcctaggtaacagagcaagacccagtctcaaaataaataaataaaataaacacaggtactgaatgactaggaaacaggaaagtgaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttatttttttgtagagacagggcctccctgtgttgcccaggctgatgaactgtaatttttaacacacacagtgtagggaatgtgaaagactatcacagagtagaagaaaaaattattttcagggttagcaggtggattgtcccaagcagtcacactagaatctgtggactgaagccacatttgccagctccaggcttctaacacatctgaaactgtgtatgtagaacagctagctcaatgcctggcatatggtaagcacacagtaaattagcgccttcctcttctccatggttccttaaaactggcaacgctaaattctctctctcagtatcacggatataatttgtcccagcagctttaattcatttaaagcagttagatgttgttttataatatcttcagttttctctcaccaatgtgttttctaattgtttaaacacttgagtgtcaaacaattgccagccaccatactaaacacaacatacaaggatagataaataagacaccatctctgccctcaagccagtcaccatcatttactaagcacctgttttgtgctaagtactggggtaagccttggggatataaagattaataaattttgagcatacagtctagtaggaggagacaaataagtacataagtaccaggaagtattaggggtgctacagtagaagagtaaacactatgtac

SEQ ID NO: 288656 - DNA, 2136 bp, Homo sapiens
gggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgtgtgaagaaagtggcagaccggctcacagagaccatggtcttgccatcccggacgcgtgggcgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288657 - DNA, 1697 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288658 - DNA, 1886 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctgtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcatta

SEQ ID NO: 288659 - DNA, 1869 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaaggtaactcaatctggaccttctccccatttcctccatacggtcaagtacccctcatgtgcccacttcgccctgagctgctgaaatagaactatgtgcattccttgtctgtcttctctttcctcagagcatagccaacttgatagaaaggaggcaatttgaaaccaaagagaataagtaagtaacattttcagttgagttatttacatctttcaagatcaagggcct

SEQ ID NO: 288660 - DNA, 1607 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccagaagttctctaatacaccagaccatgccccatccaggagtaagtagagcaacggcagtaagtagag

SEQ ID NO: 288661 - DNA, 1563 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggtaaccaaccaagggcgtaat

SEQ ID NO: 288662 - DNA, 2064 bp, Homo sapiens
accaacacttcgtgacctagcatcagattgtgcgaaccatgctctctcgccattgtcctccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttatttttttgtagagacagggcctccctgtgttgcccaggctgatgaactgtaatttttaacacacacagtgtagggaatgtgaaagactatcacagagtagaagaaaaaattattttcagggttagcaggtggattgtcccaagcagtcacactagaatctgtggactgaagccacatttgccagctccaggcttctaacacatctgaaactgtgtatgtagaacagctagctcaatgcctggcatatggtaagcacacagtaaattagcgccttcctcttctccatggttccttaaaactggcaacgctaaattctctctctcagtatcacggatataatttgtcccagcagctttaattcatttaaagcagttagatgttgttttataatatcttcagttttctctcaccaatgtgttttctaattgtttaaacacttgagtgtcaaacaattgccagccaccatactaaacacaacatacaaggatagataaataagacaccatctctgccctcaagccagtcaccatcatttactaagcacctgttttgtgctaagtactggggtaagccttggggatataaagattaataaattttgagcatacagtctagtaggaggagacaaataagtacataagtaccaggaagtattaggggtgctacagtagaagagtaaacactatgtac

SEQ ID NO: 288663 - DNA, 1924 bp, Homo sapiens
ctatgcgtgcactgactctcttaactaccacgcgctaccgatcttcagatccctacctgttggctataacatctctaagcaagttcttgatcagtatctcactctgctggcagatgatccaatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggataagtcgcagagtcttcaactaaacccccctctctatcccctgcagcccaggatacacctgaaagaatttggcatatttagatccattgctgtagtctcccctcatcaaatcttggcagtgggaagaaccttaaatcaacaaggttaatcatctatcagatgcatctgttcccataaagaagttacccacacctatggttacctatatccctggcaataggaaacttcctaagaagttaattttattttcagatgtctatgcctgttctttattttgttgagataggtgatagatagatagatagatagataatttgttgttgttgagacaggatctcactctgtcactcaggctggggtgtaatagcgcaatcacagctccctacagccttgacctcctgagctcaagcagtccttccacctcagcctctggagtagctgggactacaggcatgcaccacacatacccagctattttttatttatttatttatttttttgtagagacagggcctccctgtgttgcccaggctgatgaactgtaatttttaacacacacagtgtagggaatgtgaaagactatcacagagtagaagaaaaaattattttcagggttagcaggtggattgtcccaagcagtcacactagaatctgtggactgaagccacatttgccagctccaggcttctaacacatctgaaactgtgtatgtagaacagctagctcaatgcctggcatatggtaagcacacagtaaattagcgccttcctcttctccatggttccttaaaactggcaacgctaaattctctctctcagtatcacggatataatttgtcccagcagctttaattcatttaaagcagttagatgttgttttataatatcttcagttttctctcaccaatgtgttttctaattgtttaaacacttgagtgtcaaacaattgccagccaccatactaaacacaacatacaaggatagataaataagacaccatctctgccctcaagccagtcaccatcatttactaagcacctgttttgtgctaagtactggggtaagccttggggatataaagattaataaattttgagcatacagtctagtaggaggagacaaataagtacataagtaccaggaagtattaggggtgctacagtagaagagtaaacactatgtac

SEQ ID NO: 288664 - DNA, 966 bp, Homo sapiens
caccaaagaggcgcaggaaggagagacaaacggcccgcccgccggctccacaaacagcccctcgctggtcctccagtcttccagcgagaagaaagaaagagcgtccccggaagccgccgaaactctggggtagagtggcacgcgctttttgcttttccgcgtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcagagaacccattggacctatgcttgaacgtattcaaaccacatttgtggcgactggcaaaacaacacacttttgtacaaacgcctgccctttcgggtaacctaaccactcgcagaaattcagacccctgagccaacaacaacctggcccccactcttgcattcactccacaggcactgttcctgcttcctaatcacctgacaggcgacaggtacacgccagattctcgttgagatcc

SEQ ID NO: 288665 - DNA, 729 bp, Homo sapiens
ggcacgaggctaaaaaagggtagttgtggttggctctgcctttgctgtctttacctgaatagaggtcaggcccgggtccaggggagcgtcccacggtcccttcagcagcagcatctctaggggaagtggccggctgcagggactgcacggtgaggcaatctgtgagcaggtctggatggagctctgtgctggaccgcaactaagaggacaaaacggaagagacatcgataaggagagccggtccttggaatattttcctgggaaggcatcatgctctatcagtgcaactcagcccacaaaaatttatcaagcagcaactacgggtcctctgaacgggccacaccacggttgagccattgtgacccctgcgacacacaggtccaggcctcctggagtcacaaagctttgagcaacaggagaaccactaaagaagaagaaacagctagctcctgccttaactgattaaccgaacttgcaacattccaccattgtgatatgttcctgccctaccctaaataatcaatcggccttgtgatatcctgccatgtgaactccctccacctcgtgactatgcaccttgtgacattcttcccctgcccgaaaagactgccccaactgtaaccttccactacctatcccaaacctataaaaccagttccactcccaccgcccttcgctgactcccttttcagactcagcccgctcgcaccggagtgaataaacagcctg

SEQ ID NO: 288666 - DNA, 576 bp, Homo sapiens
aaagaactattaaggattagagggacaatgttgtctctgatttaactcaagaacttgggagatcacagagataaacttctgaagggcatcagatcttcccagaaatcaagtgcggaagttcagcggaatgctgttggacacagtaggcacaatggatgaaaattagaaaggtcctctgaacgggccacaccacggttgagccattgtgacccctgcgacacacaggtccaggcctcctggagtcacaaagctttgagcaacaggagaaccactaaagaagaagaaacagctagctcctgccttaactgattaaccgaacttgcaacattccaccattgtgatatgttcctgccctaccctaaataatcaatcggccttgtgatatcctgccatgtgaactccctccacctcgtgactatgcaccttgtgacattcttcccctgcccgaaaagactgccccaactgtaaccttccactacctatcccaaacctataaaaccagttccactcccaccgcccttcgctgactcccttttcagactcagcccgctcgcaccggagtgaataaacagcctg

SEQ ID NO: 288667 - DNA, 210 bp, Homo sapiens
aaaaaaaaaaaaaagttatttgtagaataggcttcaacttggaaggtgtttcctagtgttgcttgtaggcaggtggacaggacccggagcccagtgtgtgtgtgttccgtgtcattgttccttctctgtcaccttgagtggtgtctgctcttctgtttcctctctcctgtgtggcagtaagcagtgtctgtgtttcaggtggcagaatcg

SEQ ID NO: 288668 - DNA, 272 bp, Homo sapiens
agcaccgggtgaagaagaccacgggggaggcgcctcgtagagccgtggatcgccagcggaggcaagggatggaagtatgatgtgatggatataattatgggacactgtgtgggcacacggcctcctgcttgttgcctcatcctcctgcttttcaagcttttggccactgtctcccaggggctgccagggactggacccctgggcttccacttcacacattccatttataatgctaccgtgtatgagaactcagcagcaaggacctacgtcaa

SEQ ID NO: 288669 - DNA, 870 bp, Homo sapiens
tgtattccaaatggtttaatttaacaagtcaacaccttatcattaagcacttgagatcttgatacatattcaagttacacatctaaaaggtttccactttgcaagcaaacatggtaatgcagagacctcctatttatgaaatcatgtaaaatggttcttcagacacctctatgtcccactgatgctcaagaatcaacatttttcaagggggtattcaagcaaatgacaaccatcttatacatgcagttaaacatttttgcttttccaatgatttgcaggtaaatatgtgtgtgaggctgatggattctggacgagctccaaaggagaaaaatcactcccagtctgtgagcctggtaatggatacatttatacaagagactggtaattgatggaaaggaggactgggtaggagacagtgaggagagctttagctgtggtaggcagaaatgtaacttcagcacttggctcttaggctgttattatttccaaatagtatgttctcattacccccttcccatatacagaggttgttaggtgctgactgcatcagtcatttgattctctttgaccttataactaggcaagcataaaaaattaaatgatttttaggccaggtgtggctcacgcctgtaatcccagcactttgggaggccgaggcaggtgggtcacctgaggccagcctgaccagcatggagaaaccccgtctctaataaaaatacaaaattagccgggtgtggtggtacatgcctgtaatcccagctactcgagcggctgaggcagaattgcttgaacccaggtggtggaggttgcggtgagcccagatcgcaccattatactctagcctgggcaacagtagtgaaattccatatc

SEQ ID NO: 288670 - DNA, 576 bp, Homo sapiens
cccatgcttctttcttagttgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatctgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatca

SEQ ID NO: 288671 - DNA, 716 bp, Homo sapiens
agcggggtttcccgccgcgccgttgccgccgctcctctccctcctcacctccccgcaagctgagggagccggctctggccttggccagcccagaaaggggctcccacagtgcagcggtgagctgaagggttcctcaagcgcggcagagtgggcgccaaggccgaggaggcgcccagagccagcgagggctgccagcaagcgtgtcacctctcaataggaactggtaccaagctacttacgaagaagtattcgtttaaacctgaacctgggggaaaaacaacatgaactgttcgtctatctatatcgtcattattttttacctcatggattgaaacaaattttaaaggaaaaaagaatgttaagaaagagcagcacttactatcagggaggcacctcacgagcattgtaaacactcaggctcgctgctttctgaaggacatgccaatcatgcacagcacttactagaaactgcaagactgcacaacatgatggtatttattccaggaacaggagccagtcctgggcacacacataaagggacttccttcactccccagaagaagagaaagcatgctgacacacatctgcccaagcaatcagaaggcagctaaagccgccacagtcttcactcaccaacagttagaccttttcaattgattttattgaagaaagtgagtgctgagcaccatgagttctcataaacaatccattttggc

SEQ ID NO: 288672 - DNA, 400 bp, Homo sapiens
tcccctagttagaagttcaatagcactagttagaagtttcaatagcatcttagaccttttacctaggaaattttctttttgcttgaagtacatcattaagaatttccagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgctattgagatttctactctagtcttttttaggggcagttttactcttatgtgactagaagtagatttcttctttttttttttaatactgcttgagattttattgggtttttgaatctgtggatagatatccttcaacagtt

SEQ ID NO: 288673 - DNA, 1157 bp, Homo sapiens
tctagagctgatgatacagtcaggtatttaccaacactcatgtatatatgtagagtttcaagaaataattgcttatccttaccagattcaacatattctaacgtttcacatattatttttatttcttaatatttttttaaagatggggttttactctgttgcccaggctgaaatgcagtggcgtgaccaggatttcgaccagaagtttgactgcagcctcgaactccttctaacaaacaatcctgctgccttagcctcccgagtagctaggactatgggcacatgccaccagatctggcatattttaaaatttttgtagacatagggtctcgccatgttgcccaggctgattctgaactcctgttctcaagcaatcctcctgcctggtcttcccaaactgttgggcttacaggtgtgagtcattgagcccagcttgtattcttttgatttaaaaaaaaaatatcctgaatgtgatccaccaaattaatttcaccatccactaataggtagcaacctgaatgaaaaatactgttataaactttacacaaaaccagagattataaacatttgcctccaaggagatgagagaggcaaaaggtacttgtttgctctgatgggccctgtttccttcagtgccaggaagagtggctctcagacctttcttctggcatccctcatgtatgcagtgttggttattattttcaaggccttggtaacaaaatgcccctagtgtgaccagtcagactgacagtccatatctgtaatatggtggtaagtttcctttgcatgtctttctttctagcatcttagaccttttacctaggaaattttctttttgcttgaagtacatcattaagaatttccagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgctattgagatttctactctagtcttttttaggggcagttttactcttatgtgactagaagtagatttcttctttttttttttaatactgcttgagattttattgggtttttgaatctgtggatagatatccttcaacagtt

SEQ ID NO: 288674 - DNA, 1064 bp, Homo sapiens
aatgggggctcagagcagtcaagaacatgccccaagttattcgtcagtgaggcagaaattgtggtgtccttgtgctgaaatgcagtggcgtgaccaggatttcgaccagaagtttgactgcagcctcgaactccttctaacaaacaatcctgctgccttagcctcccgagtagctaggactatgggcacatgccaccagatctggcatattttaaaatttttgtagacatagggtctcgccatgttgcccaggctgattctgaactcctgttctcaagcaatcctcctgcctggtcttcccaaactgttgggcttacaggtgtgagtcattgagcccagcttgtattcttttgatttaaaaaaaaaatatcctgaatgtgatccaccaaattaatttcaccatccactaataggtagcaacctgaatgaaaaatactgttataaactttacacaaaaccagagattataaacatttgcctccaaggagatgagagaggcaaaaggtacttgtttgctctgatgggccctgtttccttcagtgccaggaagagtggctctcagacctttcttctggcatccctcatgtatgcagtgttggttattattttcaaggccttggtaacaaaatgcccctagtgtgaccagtcagactgacagtccatatctgtaatatggtggtaagtttcctttgcatgtctttctttctagcatcttagaccttttacctaggaaattttctttttgcttgaagtacatcattaagaatttccagtgaaggcagattcttaaagtttttgttttccagaagagatcttggaaaatataaaaggttggcagttatttcttttagtacatgagatagtattacaccaatgctgttgagaagtctattgtgaggcaatgtgtcttctttctctggctgctattgagatttctactctagtcttttttaggggcagttttactcttatgtgactagaagtagatttcttctttttttttttaatactgcttgagattttattgggtttttgaatctgtggatagatatccttcaacagtt

SEQ ID NO: 288675 - DNA, 1242 bp, Homo sapiens
aatcttcacgagcgactctgccgccgcccaatcagcgccagatttgcgtcccgccaccaatccgcgctgagcagcggggcgggaccaaaggaaaggaccaagctcggttgaggcgcggcccagccgcagccgcagtcacagcctcagccgcagcggccgtgctacctaggtgatagcggagcggctgggtaggaagcaattgttctcaaacttcactagccccgtcggcgcggacgcttgtcgagaatgcagattcctgggtactgccagatacgaattgagcataccacaaaaaagttctcattttgtgtcctcccatcccattctcctcactaaccaaaggctaggaattatctgtgaatgtaggaccactggatttgcagtcttcatctgacactgtggagagtttctaggaatgaaacagatatatggccttgggtcccctttttttttctttttttttttttaatagagacgagcatctcactatgttgcctagggtagtcttgaactcctggcctcaagcaatccccacccgactccgcctctcgaagtgatgggattacaggcgtaaaccaccacgcctggccagaaggtgctttaacaccaaatctgaaaattgttcagaagagaaacattgagcatgaacaccatctgtgcgagtcatttacttattgcccctcacctctaaatctaccttctgtactcttcttccctgtaatgatggggctagttgtcctcaaactgtttctcagacttctttttaagcttgcttcctgttcagttctgccaataggggtcactagagagagactgggaggcagaaggagagaatatgcttcctgttttttctgttcttgttaatgttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaataaatttcctccattgaaaaaaaaaaaa

SEQ ID NO: 288676 - DNA, 1826 bp, Homo sapiens
aatcttcacgagcgactctgccgccgcccaatcagcgccagatttgcgtcccgccaccaatccgcgctgagcagcggggcgggaccaaaggaaaggaccaagctcggttgaggcgcggcccagccgcagccgcagtcacagcctcagccgcagcggccgtgctacctaggtgatagcggagcggctgggtaggaagcaattgttctcaaacttcactagccccgtcggcgcggacgcttgtcgagaatgcagattcctgggtactgccagatacgcagatacggttggtgatcttgtagggctggagtggaagccatgaatctgcattttcatcatttctggccctctgcccgggctggggtgattcacggggattcgtagtggccccaaaggagcacgcagaacctcggctgctgtgcatttatcacctcttttgttcccggaggccgcaccccaggtccagtttacacagctgccaactccttttcttggttcccactggaatctaggaagaaaactcgccctttacttctccgccccacacccgacgacggagtgtctagaggtctggtcggccttggctgtgcggagggctaggcctgacgagcgggcgctgatgcggcgcagaccccgccggacctcttggtcggcccggggtaggctggggagccgcgggaacaggactggatagggaaagcggcaccgcagcgtccacgggcaagctgaaagtccgcttgatgtctttgcatcacagtggcgccctccccgcaggaacgcccggccgcctgcaccgaacgtttgcctgcagggaacggccaacccgccctgaaatactctttttgtgggctgcagctttcggaattgagcataccacaaaaaagttctcattttgtgtcctcccatcccattctcctcactaaccaaaggctaggaattatctgtgaatgtaggaccactggatttgcagtcttcatctgacactgtggagagtttctaggaatgaaacagatatatggccttgggtcccctttttttttctttttttttttttaatagagacgagcatctcactatgttgcctagggtagtcttgaactcctggcctcaagcaatccccacccgactccgcctctcgaagtgatgggattacaggcgtaaaccaccacgcctggccagaaggtgctttaacaccaaatctgaaaattgttcagaagagaaacattgagcatgaacaccatctgtgcgagtcatttacttattgcccctcacctctaaatctaccttctgtactcttcttccctgtaatgatggggctagttgtcctcaaactgtttctcagacttctttttaagcttgcttcctgttcagttctgccaataggggtcactagagagagactgggaggcagaaggagagaatatgcttcctgttttttctgttcttgttaatgttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaataaatttcctccattgaaaaaaaaaaaa

SEQ ID NO: 288677 - DNA, 1550 bp, Homo sapiens
tttaaatttagaaataagtatttaatctttacaatgctgtttttagcatttaccaagatgaacacatgattttctccttcaatctgagtttatgtaattaattacattatacatttcccaatgttgaggcatcctgacgttcttagaataaatcctactgggtcatgatgaattgatttttaaaaatattataatgttagatttaattaggtaatacatatttataattttaaaattcatatttgtaattgagacttgccagagatttcttcttttgttttcatggtctattgtcctccagctttgacatcaggtttatgctaatctttaacagacacttagcctgccaacttgatgtaatccacagtaatgtctccctgtaagatttctgaagagattggtgtgaggtagatattattatcatcattttttttcagatgtggtaactgaggcacattgagaattatagtgtctaacgtttatgatataagtcagtgactagcaaactacttcttatttatgaaaatactacaattattcttttaatttctggggttgagaggagggcaaagaattattactcctgtgatcctctccagctactcaaactaatattgttgtttatttctgtttctctctgtttttactaggctaggaattatctgtgaatgtaggaccactggatttgcagtcttcatctgacactgtggagagtttctaggaatgaaacagatatatggccttgggtcccctttttttttctttttttttttttaatagagacgagcatctcactatgttgcctagggtagtcttgaactcctggcctcaagcaatccccacccgactccgcctctcgaagtgatgggattacaggcgtaaaccaccacgcctggccagaaggtgctttaacaccaaatctgaaaattgttcagaagagaaacattgagcatgaacaccatctgtgcgagtcatttacttattgcccctcacctctaaatctaccttctgtactcttcttccctgtaatgatggggctagttgtcctcaaactgtttctcagacttctttttaagcttgcttcctgttcagttctgccaataggggtcactagagagagactgggaggcagaaggagagaatatgcttcctgttttttctgttcttgttaatgttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaataaatttcctccattgaaaaaaaaaaaa

SEQ ID NO: 288678 - DNA, 1188 bp, Homo sapiens
aatcttcacgagcgactctgccgccgcccaatcagcgccagatttgcgtcccgccaccaatccgcgctgagcagcggggcgggaccaaaggaaaggaccaagctcggttgaggcgcggcccagccgcagccgcagtcacagcctcagccgcagcggccgtgctacctaggtgatagcggagcggctgggtaggaagcaattgttctcaaacttcactagccccgtcggcgcggacgcttgtcgagaatgcagattcctgggtactgccagatacgaattgagcataccacaaaaaagttctcattttgtgtcctcccatcccattctcctcactaaccaaaggctaggaattatctgtgaatgtaggaccactggatttgcagtcttcatctgacactgtggagagtttctaggaatgaaacagatatatggccttgggtcccctttttttttctttttttttttttaatagagacgagcatctcactatgttgcctagggtagtcttgaactcctggcctcaagcaatccccacccgactccgcctctcgaagtgatgggattacaggcgtaaaccaccacgcctggccagaaggtgctttaacaccaaatctgaattattgcccctcacctctaaatctaccttctgtactcttcttccctgtaatgatggggctagttgtcctcaaactgtttctcagacttctttttaagcttgcttcctgttcagttctgccaataggggtcactagagagagactgggaggcagaaggagagaatatgcttcctgttttttctgttcttgttaatgttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaataaatttcctccattgaaaaaaaaaaaa

SEQ ID NO: 288679 - DNA, 1160 bp, Homo sapiens
aatcttcacgagcgactctgccgccgcccaatcagcgccagatttgcgtcccgccaccaatccgcgctgagcagcggggcgggaccaaaggaaaggaccaagctcggttgaggcgcggcccagccgcagccgcagtcacagcctcagccgcagcggccgtgctacctaggtgatagcggagcggctgggtaggaagcaattgttctcaaacttcactagccccgtcggcgcggacgcttgtcgagaatgcagattcctgggtactgccagatacgaattgagcataccacaaaaaagttctcattttgtgtcctcccatcccattctcctcactaaccaaaggctaggaattatctgtgaatgtaggaccactggatttgcagtcttcatctgacactgtggagagtttctaggaatgaaacagatatatggccttgggtcccctttttttttctttttttttttttaatagagacgagcatctcactatgttgcctagggtagtcttgaactcctggcctcaagcaatccccacccgactccgcctctcgaagtgatgggattacaggcgtaaaccaccacgcctggccagaaggtgctttaacaccaaatctgaaaattgttcagaagagaaacattgagcatgaacaccatctgtgcgagtcatttacttattgcccctcacctctaaatctaccttctgtactcttcttccctgtaatgatggggctagttgtcctcaaactgtttctcagacttctttttaagcttgcttcctgttcagttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaataaatttcctccattgaaaaaaaaaaaa

SEQ ID NO: 288680 - DNA, 1253 bp, Homo sapiens
aatcttcacgagcgactctgccgccgcccaatcagcgccagatttgcgtcccgccaccaatccgcgctgagcagcggggcgggaccaaaggaaaggaccaagctcggttgaggcgcggcccagccgcagccgcagtcacagcctcagccgcagcggccgtgctacctaggtgatagcggagcggctgggtaggaagcaattgttctcaaacttcactagccccgtcggcgcggacgcttgtcgagaatgcagattcctgggtactgccagatacgagatgaggtctcgtcatgttgcccagggtagtcttgaactcctgggctcaagtgatcctcctgcctcagcctcccaaagtgttaggattacagaattgagcataccacaaaaaagttctcattttgtgtcctcccatcccattctcctcactaaccaaaggctaggaattatctgtgaatgtaggaccactggatttgcagtcttcatctgacactgtggagagtttctaggaatgaaacagatatatggccttgggtcccctttttttttctttttttttttttaatagagacgagcatctcactatgttgcctagggtagtcttgaactcctggcctcaagcaatccccacccgactccgcctctcgaagtgatgggattacaggcgtaaaccaccacgcctggccagaaggtgctttaacaccaaatctgaaaattgttcagaagagaaacattgagcatgaacaccatctgtgcgagtcatttacttattgcccctcacctctaaatctaccttctgtactcttcttccctgtaatgatggggctagttgtcctcaaactgtttctcagacttctttttaagcttgcttcctgttcagttgcttacaggaccagcaatgcttcttcacctagagacacttctcccagcagtggcagtgccacttcagcttctttcagcactactggaatcagcctcagtgattccccctgtacccgctcagagattatccacagcagccagatggttctaccttccacaaagattgtggttgcaattctgggcttctaagttctggttacttcatatttttccttttgttcctccagccctagaggtggtagctgctttctgaagttattatttctagatgacttttggtttttcagcctttgtattttgcttttcagccctctaatgcctgtataaccaatttccctgtaataaataaatttcctccattgaaaaaaaaaaaa

SEQ ID NO: 288681 - DNA, 424 bp, Homo sapiens
gaaatactctttttgtgggctgcagctttcgggtattttaagccatggttctgtgcccttccttgttttcaaaaacaccacagccaaaggctgcgggttgtgtgctttcattttgtgttaagttctgtggtggagacctggagtctgtttttccaaataggcaccttgaaatagatacgcttcttaagcggggaaagtacgagtaggtcctattatttgcaatgttttagcctttccagactccgtacaaatgactaaatgaagattggatcgtattttcaggcactgcaccaatgatagaaaattctcaacttggggtcaaaagcaagggcagctttcgtttttcttaaatatgcttctgatcaaatatctaaagtgttgaaagaaacctaacccttaatagcacaatttacaggagtgcata

SEQ ID NO: 288682 - DNA, 247 bp, Homo sapiens
tgtggaggataagaacgctgacaataataatgagtacgataatatcagtgccttggatttatgcagtatcattacttcggggctttgcgtgcctcctatgtagtatgtagtctataacaaaaaactgtaattacaaacatttcacaagaaatcattcttattgtgatatttttattacttgcagaattgagcataccacaaaaaagttctcattttgtgtcctcccatcccattctcctcactaacc

SEQ ID NO: 288683 - DNA, 1939 bp, Homo sapiens
ttagacgtcaccacagttaataaaaactccctacagaacatcccataaaataaaggaataaatcatctaggaaataaagtcagcacaggtactgacagagaaacaccatggcgattgagactccgtgggactccgattttgcttgtaacaaagctttccaggtgtgagctgctcctctcccccatctgcccctcctcaaagaaacaacactaaaagaggtgaaagtaaatacacctgatacattcaggaaataagatttgccagataaggtcaaaggaagttagtacattaaacaaatggtggtaggagggaggatttggcccaactggctccaacctatctggtcaacacgtatgttgggtagaacagaggtggagaaaagcctagatcagggatgtatacgcttccttggggcagacgcagcctggccctgcggagcgatttcaagcctcgttcacgaacatggccaaggacactgccagcctcttcattcccctgtgtggatgctccaactccaaaagtggaaccacagggcaaatgaatgtcggcacgtgtcggtatggcagcctcgctcttcgacagctggtgtgggggttaccacctggggctagctggcctcatcttcgttagcactgagactggtctaccagttgcacagattcagatttgaaaatctcaggtgcaaatcccaagtggcgatggcatgtaaccacatcaaactcaacatctgcacctaactcccaccttctttctctgggaaatcttcctggacatgcccagatggactcaggagcccatcacctgtaaatccccacactgcagccctgccacttgcttgtctgcatgtgtgggtccgctggaccactttggtgtatctttgagccccttgagtgaaaaaatgctgcctggctggctccctgattagacatccaacataatgaggactaacaccaatacaaacacttaagagatgacatatcgccctagctggatctactacagggaagggaagagggtgctgggtccaggcaggctgagtgtctcatgtcttaatgcttctctgcccaatctatttccggctggatgtggagtctgaaggcctggcacccactctggctctgtgatttaccagctgtgagccttgggggagctgcttactctcttggtgattcttttctcatttctatgatggggtagaggataatgcctatgcttacaaagtggctgtgggaagtaaaccggatgggataagaatggcttgctgtggaccacaggcaccgcaggataaccattcctcagaactcctcgtactgctctagtgcttggaggtccgtgtattacctcagctattccaaccgcaccaaccacgggagccacgtgtctacgtctgacagataaagatgctgagtttagagtctgcaaggcttgacaaccacagatcagggacaggagctgaggtctcctgacctggagcccagggccacccggagctgcaagaaacctgcactcacaactgcctcctattttaaaatgctgagtcgatcccacaggtggcaaaccagttctgggcttcaatttacaagcagtcagaaaagctgggttgaaatcgccactgtccttctatgtggctgatgaggaaggatgacggtgcccaccgctccatctctccagctgaccccaagctggcactcacgggtgggcaggctcagacaggcccagctccaccaagtgcacttgaagccggaatgcaagacatccgatggtatacttactcgaacccgtccttttcacaacagccgcgggatccgctttctttggctgactgctcagagtcttcccttttcctgtgaccccattagacgccacggggggctttttacccttgagctgttgaaataaacatataagaacattaaaaataaacacaaagtcaaacaaa

SEQ ID NO: 288684 - DNA, 374 bp, Homo sapiens
tcaggtcctgcaagcccttgcttgccatggcttcgggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttccca

SEQ ID NO: 288685 - DNA, 3194 bp, Homo sapiens
  misc_feature (500)..(500): n is a, c, g, or t
  misc_feature (1255)..(1255): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttccca

SEQ ID NO: 288686 - DNA, 1752 bp, Homo sapiens
ctggctcttgaggagccacccgcggcggggtcgtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttccca

SEQ ID NO: 288687 - DNA, 4800 bp, Homo sapiens
  misc_feature (500)..(500): n is a, c, g, or t
  misc_feature (912)..(912): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccggtgaggatagcgcgcgacctagggctcaggcaggggcacctgcgtggatgcgcaggcagaagcagcgggtcggcgcggtccgcaagttcctggaccggcagcttggctcggaaggctcggtcctccactgagacgcagggggcaggcagaacgcccaccccggcgagcagacagatggtgcccgcagggaggcagcggaacagaggctccggaggagccggagctgcgctgcgggcactgcgggagcccctccaaggaggccatgctggcgctgggcggcccgcccaggccctcaggagagggtgaaggtccaggacagggatcgggcgcggcccgccaccacttaaacccgcgcgcgccaccagaggctgccccagacctcaaagggctttgtttccatcccacccccatcgccgaaaagtaatcgtcgccttacctttaagtccccacctggcaaagaaggtccttagttcctccacctccagctctctcctccgtattctggaggtgacccagctgcggtgggggcgtgggagatgtcaggagaccactgggttggttcttcctgcacctagcccaggcttcgttaggactccagctccctgtcagtcctgcccatatcccagtcaggagacaatatccaaaccaaccccttacttcaccagtgctccaggggaggcccacagttcttcccttgagactgaaatgctaccaaggaagcctccgtgtcaggtcccttccttctgggcttcacttttccatctgagagctgggtgcaaaggatgggctgctttctgatgggttaatcgagacgaggttcccaggggcctctcagcacacttgcctgactaaccctttccggaggatgggatctgggtaaggcaggccctttcctgttcagcagcagggatgagttacagctctgtaggcgggagccacctgtcagcccccccggggctggtgactccattcccagcaggccgaaactctggtccagaggagatagtccggccttggaagttttgcctccttccttcatttgtctcctaatgtcttaagctgcctgtccacagaggcactggctttgcttgtgtgcccctccgggcaggccacaggagggaggaggcagtaaggacctggcaaaactgcaagccccagggctaagtgcatgaaaggtgggaattcaggcatctgggccaggcttctaggggagaagctgtaaaagggggcaagggtcttctgcgccatcaccagcattagccaacagtccagatgctagctgcagcctggccctgccctgccttccttcctctgtccaacattttctcagtagccctggagatggaaagggaagctcctcccccacagagaaggagctcagagttagaaataaacaaaaacatcccagaggcatggaaaggtctcctgcccctcgggctggggggccctgggccagggactttatctccatggcatccatcccttggacctgtaccaccgaatactctggaggacacagaggcatggcaatggtggggcacctgtagtcggtggtgcctcaacaggggctaaaagccacatctctctgttccagtgtcagcggccggagcggcagctcagcaagtggtggaccaggccacagaggcggggcagaaaggtctggtggggctggagggaggcgggcaaccccagcacacctcccactccccgccccatcccggctggggcccaggcacatcctctcctctgcagagccctctgtccacaatgccccaagcaggtcccccgggagacccaggccaggctaagcctacaggcactgtggttcccgggccctgcctgacctgccctctctcccgcccttccccagccatggaccagctggccaagaccacccaggaaaccatcgacaagactgctaaccaggcctctgacaccttctctgggattgggaaaaaattcggcctcctgaaatgacagcagggagacttgggtcggcctccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcggtaaaatacctgttttctgacaagactaggactcttacatagactgccatgaactacaagaagtatagcattgctcaaataac

SEQ ID NO: 288688 - DNA, 3423 bp, Homo sapiens
  misc_feature (500)..(500): n is a, c, g, or t
  misc_feature (1255)..(1255): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaaaaaaaaaaaaaaaaaaaaaaaaaaaaaaaaaaaaaaaaaaaaaaacaaaaagaaaaatggtggcggggtttttttttggggggggggggagaaaaggggtgttttgagaggggggagtgtgtttaaaattgtttgtttctggagacaccatttttttttgaagggggggagaaagcgggggggccccctagagggggggggaaaatggaaacggaggggagcgggttt

SEQ ID NO: 288689 - DNA, 3461 bp, Homo sapiens
  misc_feature (500)..(500): n is a, c, g, or t
  misc_feature (1255)..(1255): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcggtaaaatacctgttttctgacaagactaggactcttacatagactgccatgaactacaagaagtatagcattgctcaaataac

SEQ ID NO: 288690 - DNA, 3497 bp, Homo sapiens
  misc_feature (500)..(500): n is a, c, g, or t
  misc_feature (1255)..(1255): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaaaaaaaaaacatctaacactctcctccaacttttatcccctcataacacaaatctacttgccggcgtttacatggtcgtgcatggaaaccttggcgttacccacttactcgccttgaagaacatcccttttcgcagttgcgtataggcaatagcccgactgatgcccttccaacattgcgcacctgatggcaatggtacattgaacgcagtattttgtaaactcgcgtaacctttgttaactaaccctttttaccctttcgcgtacactcgcactcccttacattcaatcatcggcccgtccg

SEQ ID NO: 288691 - DNA, 3131 bp, Homo sapiens
  misc_feature (500)..(500): n is a, c, g, or t
  misc_feature (1255)..(1255): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttccca

SEQ ID NO: 288692 - DNA, 3407 bp, Homo sapiens
  misc_feature (500)..(500): n is a, c, g, or t
  misc_feature (1255)..(1255): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaaggtctggtggggctggagggaggcgggcaaccccagcacacctcccactccccgccccatcccggctggggcccaggcacatcctctcctctgcagagccctctgtccacaatgccccaagcaggtcccccgggagacccaggccaggctaagcctacaggcactgtggttcccgggccctgcctgacctgccctctctcccgcccttccccagccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttccca

SEQ ID NO: 288693 - DNA, 3360 bp, Homo sapiens
  misc_feature (500)..(500): n is a, c, g, or t
  misc_feature (1255)..(1255): n is a, c, g, or t
ttttttttttttagaaatggaatacacattcattagcatgcaaggggaaatcagagtgactgccccaccacgaaatggggtacagatgagcaatggggaagtgtgggtaatttcagggggctagtaaatgattttcaggggaattcagtgggcttgaagaacatacagtggcctgggacaaagtctgttgggctcacagagcagacaacggtttgcaaaatctgtccaggtatgtgagcaggcttcagtctttcttcctgtgacagcagttcagtcagagaaaactccgggaagggaccagtggtcattgttttcttctttggtgggtccagacttaaggcagatgaggaacttcagagaacaacttcactgtatgctttggaagagacaaagggttggggggcctgtgggagtctggtcggagagaccttaaggcttcttcagttcagaatgtcacaccactatatttcggggtattggtttctgagccccaacaatgngtaactgaaactgcagaaagcgaaatcacaaattagctgggggtggtggctcatgcctgtaatctcagctactcaggaagctgaggcagaactgcttgaacctggaaggcagaggttgcagtgagccaagatcccgccattgcactccagcctgggcaacaagagcaaaactctgtctccaaaaacaaaaaaagggaaaaaaaaaagtgacaccacagcaaactggggcgggggtgggggaaacggtaatgcggtaatgcgctccctccttctgcctctccttgtctgagaagccctggtgccctgcacgctctcacaaggtccactgctgagtcctgggcacccttcagccaatttaatcttcacacacacactttggggagacgctgtgatgtgatggggatgttgaggctcagagaagtgaggggcttgctctaagaatatctgaacccaagaggtttgactgtagtgcctgccgctagggccacgtggagctctctctaccaccatctgctgggggctggctgtctcttcccacagaggctgctcccttcctgtccagctcacagctcattgcccatggggcctggagcccagtggcaccaccagcctgtgataaactggaacactcgaaggcctgcctggctattgggcactaccggtgggatttcaggagggctggcagggctgtggccagccaggcagggcatggctgagatgggctccccagagtccccaaggcatccatatggccnctcccagggcaaggcctcgctctgggagaggaggggcggggggctgggaggactgttgctgccgctttgttttgcctgagacctgctccctcccccttcctccacctaatctcatcacctgcctcttccctttgcccagggttgacctcatctccattaatccatacgtttgtgtgtgtgtgtgtgtgtgtgtgtgtgtgtgtgtgtgtgtgtgtacaggtgcacttccaaacaactccctctaggggctgaccccgcagcactagaagcagggtatgtgccagcagaccaagcctgtgtggcaggggcttcccagcgctccagaataggggagacaccagcagaggtgcaagaaacagccccggacaggaagcggtagagagacccagaaaggcagggtgggtgtgcactggcctccaggtcctgaaggcctactctggagtgggagtatacccagctgggtggggcctgacctacaccccttgtgtgccaggggaatgtatcttgcaagctgttttgctgcacccaaggatgatcttctccactcaggcccaggtccctaagtcccctcctaacagccacaagtcatactctctagcgccttgcctgccccatctcaggaaaggtgacctgagaggcccaagcttattcctgccctccctgagccatgcttcctgcccaacttcctaaggcttcggtgacagacggcaatctccttgcctgggctgcacaggcacactgccctctcccccttggggttgcatggtctgcaagtgcacacacctgtatctcgccctctcaggggaaagatttaccaggccctctccggctgcatccactgggtctctggctacaggcagagagccagtcagcagtgcccctgcagctgtttggggctgggggctccgatgatgccagagccctagggtttacaggcacctaggcagattcgaggatccaagtccctgccacatgcgtttgggtgagaccgacctcactgcctcagtttcctcctatacactgatgctatcaacaaaaatacccacttcaggaggtggttgtaaagattatacaagagactgcagagcgttaggcagcacctggcacaagacaaatgctcagtaaaagaccactgctgtcattaaggtcaacaccagccctgagctcctgccctggagctgacccagcgctcacgcccaggatcagaaagggagggctggggctgatgagctgggaggtggtgtgcgcccttctcctgcctccagctcctctctggacccctgtcctggcacctcttcggtccctggttcggtctgcccctttcccaccgcggcccgtcttaggccaggatgtgctccctgccctgcggactctggagcagggcccggccactccccggagcctgtatgacgggaaccgccccgcgccctctcccctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgccatggaccagctggccaagaccacccaggaaaccatcgacaagactgctaaccaggcctctgacaccttctctgggattgggaaaaaattcggcctcctgaaatgacagcagggagacttgggtcggcctcctgaaatgacagcagggagacttgggtgaccccccttccaggcgccatctagcacagcctggccctgatctccgggcagccaccacctcctcggtctgccccctcattaaaattcacgttcccaaaaaaaaaaaaaaaaaaaaaaaaaaaaaaaaaaaaaaaaaaaaaaacaaaaagaaaaatggtggcggggtttttttttggggggggggggagaaaaggggtgttttgagaggggggagtgtgtttaaaattgtttgtttctggagacaccatttttttttgaagggggggagaaagcgggggggccccctagagggggggggaaaatggaaacggaggggagcgggttt

SEQ ID NO: 288694 - DNA, 668 bp, Homo sapiens
cgcagggggtggtgggcccatggaccccgatcagcagcatgttggagcctaggaggcaaaaggtggttactccacccggatgcatcaggacaggcacaggaagaagaggaaatatgagagccaaaggaaaggaagcagaggcacagtgaagtcagataattcatctggagtcacacagctggggaccagcagaactgggatttaaacataaagtctgtccaacttggagctaaagcacttacctgagagaagatggaaggaaaaaaatccacaagcagaagtctctcaccactgcctctagctataacctgtatctgacaccacaaaacatctctgggcgtggcggtcttcccccaccccctcaaatatgtccagctcagttcctgtgagtttaatgcatgttaaacgcagcactgcttgttcttcaaggcagttaaggaaggaggcccttctggtataccccgagcacactggggttcctggaccatttcattaggaaaattgctcagcggctccaaagaatctggagctccctggtctatctcccagcctctcaagccgcctccagcagggtcccgccccaaattctccacattcccctactccaaaatctacagaatggaccatttaaagcttgagccaagagatacagcaaactcacccattaa

SEQ ID NO: 288695 - DNA, 855 bp, Homo sapiens
tggtagagatggagttttactatgtcacccaggctggtctcaaactcttggcctcaaacaatctttctgccttggccttccaaagtgctttgattacaggcatgagccaccgcacccatttggccctaatgcaatattttgaccaaccaaaaatcagttcatcttgactgtgagggcccaaaagggcagggaagacgaggtgggaaaagagaaagcaggggttatgggacaagagctactacttggctgttacctcctctacagctccaaacaagcctattaggtgggtcctgttattaatcctgttttacaggaaaggaagcagaggcacagtgaagtcagataattcatctggagtcacacagctggggaccagcagaactgggatttaaacataaagtctgtccaacttggagctaaagcacttacctgagagaagatggaaggaaaaaaatccacaagcagaagtctctcaccactgcctctagctataacctgtatctgacaccacaaaacatctctgggcgtggcggtcttcccccaccccctcaaatatgtccagctcagttcctgtgagtttaatgcatgttaaacgcagcactgcttgttcttcaaggcagttaaggaaggaggcccttctggtataccccgagcacactggggttcctggaccatttcattaggaaaattgctcagcggctccaaagaatctggagctccctggtctatctcccagcctctcaagccgcctccagcagggtcccgccccaaattctccacattcccctactccaaaatctacagaatggaccatttaaagcttgagccaagagatacagcaaactcacccattaa

SEQ ID NO: 288696 - DNA, 2824 bp, Homo sapiens
ctcccggcctggtggctgcttgattatgtcaccagactctttcagcatgtacgtcccatgggacttcttcccttcctcctcagcccccgatcctggctcctcctcggcctcagccctctcctagctctcccctaagcttcttgagtctccttgctgaccagcagtggccacttctccagctctgaccccagtaccaactgtcccctagacggggaccccagctacagaattcccacctgcccaaaaccaaacgcagcatcttcccatcctcccagacctgtgcttcctagcgcgtcccccatcagtggggcaccagcgctggggtgctgccttcacccttcccctgtgtggctcccacatcctagtgtgaccggatcccacgtccgagctctactcacctcccaaacccagccagcttcctcacccctgttgccctgccttcttcaaaggttgtggttgctaattggtgtccctacctccgcctcatcccccttccctcctgcatcctgcagccggggcgctttctccgcccccctccgagttcctccattgtcaggcactgctgccttcctgcctcccaaggcctcccacagtccagttcctctctcctggttcctccccatctgcctgttgttctccctgttacggcacacgtgccctttactgattacaacctcggtatgtgtcatcctctgcctttactgccatttcccattcccctcccttcctggagaactcttagtcatccatcaaaacccagcgcactttcacctcctctctgaagctgtctctgactcttaggcaggcgtgcacgtcttcctctttacttgcactcatgtgtttgaaatggttcagccctctactgcaggaccagtccatgagctcccaagaagggcagggatgtgtttaagtcatccttgtgtttctcacgtctcacacagggcagggtgcagaggaaaacatgccgcatgggagtgtagaggagatgagaccatctcatgagggactcatgcccgaagtgtgtgcatcatccgttcacaaagtgccttcacacccctcgtgcagagcagtgtgcccagcccaccgccaggagagggacgcccagcgcgtcgtggtttgctgggtcctgcactgctgtcccaccttgctcccttccacagctggtcagcttgcaggtctgccggcttctctccacgaggcctctccagccccagtttgtctgtcagaagcgcagagacccccagcctcactccccaggcctctgcatgggcttgttcctgctccagaacacctttccctcccgctgcccagcctcgcctccacatcacagagcgcctgactcctgtgcccccagggcacatcacagatcgcccacacgtttgtctgttgagtgcagcgacaagtcaccagactaagtttgagtcggtggcgggaattggcttatgtccccaaagtggctgtacctgccgatgatccaaacgtacctactgtgccccgagcccatgagccccttttgtcctcgaagggccatgagaagtaccctctgccgcccctcatgcacagctgagggagaggaagtgagcgccactgcttgtgacgcagccgggactccagccccaggctgtggctctgcagcccctgctcctttctgcggcatgtgggtggacagtggtggagagtcactggctggggctcggggacgctgctcacagccttacagatcctcctgttcgtgtgtccacagtgctcttaccactgtctccttccgggttcccagggctgctgtgggaacacttttgggatgctaccaccttggcccccatgcctgggcgccctccatctcgtcacctgctggaaaggaaaaacagaccttttccctgttcatggcaggccatggcccgggcacctgcctgagctctctggcagtaggagctaagggtggcactagacagcctgtccgtccgccatggcttcctttagggtccctgtggagggcagggcagggttgccagataaaatacagagtgcctatttaaactgggatttcagataaacaagtaattttttttattataagtatgacccatgcaacttttgaacatacttatactcaggaagtattgattgtccacctgaaattcagattgaatgaggcgtcctgtatttttatttgctaaacctggcaacctgagggaggaaagaaggacacctccagcctcccgggccttgagggagtaaagctcaggaggtgagtgagtctcttgactcttgacttctctggtgcaagacctcaggtccgtgggggcagaaaaacttgattgtggtgacacctagtgaccagcctgggaaatttcaggaatcaagggagaggaacggggaagaaacgaggcagggcaggggctccaggtgaggagccagcaggcaggggagagggagcgggccagccttacagagcaccccctgcagcttgagggatctgagctggagcccatcacctctgttactgcccttgaacactcttacaaaagaaagttttaagctgggcgtggtggctcacacctgtaatcccagcactttgggaggccgaggtgggaggatcgcttgagcccaggagtttgaaaccagcctgggcaacatggtgaaacctcatctctacaaaaaatacaaaaattagtcaggtgtggtagcgcacacctgtagtcacagctactccagaggctgaggcaggaggattgcttgagccctggagttcaaggctgcagtgagctgtgatttgattacacccctgcactccagcctgggcggcagagtgagactctgtctc

SEQ ID NO: 288697 - DNA, 491 bp, Homo sapiens
tgacctcgtgatccgccaccttgacctcccaacgtgctgggattacaggtgtgagccaccgcccccagcgataaaacattcttattgactttcgagtggcaaaataataaagatcatgccttccttcctctttactgtgttacaaattgtataatgaacatatattattaattatgtggggcaatgtatataactggcttaagtttataaaataacgtaccagcatccggtgcatttggctttattacactgcagggccatccaaagcaagagcctctagacctctgggtggtgaacaaatctcaactggggtttcgtgcctacctggacgacatctgctcgtcaatgtgtagttaacatcctgacagacccttctgccgctggatatgtgaggggcacagcacagggctctggaagtccctgctgactgctcgaagcctttctccctgctaaaacctctgaccaaatgcttaataatatctgctgtaggc

SEQ ID NO: 288698 - DNA, 367 bp, Homo sapiens
tctccaggcaattcatccaggctgtcccctgcaagctgctcagcccaccagatctgctttggggagcgcattaaacatggttatgcaatgattgggtggcggatgccatagacatctggccctatgacaagggccatccaaagcaagagcctctagacctctgggtggtgaacaaatctcaactggggtttcgtgcctacctggacgacatctgctcgtcaatgtgtagttaacatcctgacagacccttctgccgctggatatgtgaggggcacagcacagggctctggaagtccctgctgactgctcgaagcctttctccctgctaaaacctctgaccaaatgcttaataatatctgctgtaggc

SEQ ID NO: 288699 - DNA, 1919 bp, Homo sapiens
  misc_feature (2)..(2): n is a, c, g, or t
  misc_feature (207)..(207): n is a, c, g, or t
  misc_feature (558)..(558): n is a, c, g, or t
  misc_feature (660)..(660): n is a, c, g, or t
anacagtactgtgctgctttttcaaccatggagaggtcacccgtgtgatgtggacacaacctctccgtgaaagtttttcctatccattccttgtacttcagatgtatattttaactttgattctcagggactgtattattcctatttcaagactattgtggaaacaccctcatttttgaatggagtatggatgattatgaatgatanactgactgaatacccccttgttattaatacattaaaaagattcaatctttaccctgaggtaattttggccagctggtactggatttataccaaaataatggacttcattgcaattcaaaccaagatatgtcggacggttaccagaggagaaggactcagtcctactgaaagctgtgaaggattgggagatcttgcttgcttctatgttgctgtaatttttattttaaatggactaatgatggcattattcttcatatatggcacatatttaagtggcagccgattaggaggcctggttacagtgttgtgcttctttttcagtcatggagagtgtacctgtgtaatgtgganaccacctctccgcgaaagcttctcatatccatttcttgttcttcagatgttgcttgtgactcatattctcagggctacaaaactttatagaggaagtttgantgcactctgcatttccaatttatttttcatgcttccttggcagtttgctcagtttgtacttcttactcagattgcatcattatttgcagtgtatgttgtcgggtacattgatatatgtaaattatggaagatcatttatatacacatgatttctcttgcactttgttttgttgtgatgtttgggaactcaatgttattattatgctgcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacatggagtttcactcttgttgcccaggctggagtgcaatggtgtgatcttggctcaccgcaaccttcctctcccaggttcaagcgattctcctgcctcagcctcccgagtagctaggattacagtgaccgcccacccgcacctgctgaacagcaaggtccacggagtaggaactgaacgtgtcagggactatgtgtggcactgtatggcaagtctccaagactgggaagcaccgctttacatagtcctcatggattccaaagcatgagttgggctgcttttgaatagtgggagacgggagtttaccccgatcacagaaaccataccaactgaaagacaaatcagcatcttgctggacgacccctcacagagctcctagatccttgaagtgtgaacttcagcagctgagagagatggggtctcactatgttgcccaggctggtcttgaactcctggactcaagcaatcctctcacctcagcctcccaaagtgctgggattacagattttataaatattgttgatctttttgaaaaaccaactgttggcttcattttctttattgtgtaatactaccttagaggacagcagttcctaatacctacttttattatgagtctctgccatttataaagaactgtggacagcacagggaatgggggaagaaaactctggtgcagcttgaatcttggtagcaaaacagtgacttcatcagaaaattttgtcactctctattagatataatggagtttgaccatttggaatttggaatttttcaaatgaatatgacaaaaatttaaaaaactcttgtattactatgtgataacacagatctttacaactttatgtttgttttatcaattacatattaaagatagaaaatggaatgtgttg

SEQ ID NO: 288700 - DNA, 2177 bp, Homo sapiens
  misc_feature (2)..(2): n is a, c, g, or t
  misc_feature (207)..(207): n is a, c, g, or t
  misc_feature (558)..(558): n is a, c, g, or t
  misc_feature (660)..(660): n is a, c, g, or t
anacagtactgtgctgctttttcaaccatggagaggtcacccgtgtgatgtggacacaacctctccgtgaaagtttttcctatccattccttgtacttcagatgtatattttaactttgattctcagggactgtattattcctatttcaagactattgtggaaacaccctcatttttgaatggagtatggatgattatgaatgatanactgactgaatacccccttgttattaatacattaaaaagattcaatctttaccctgaggtaattttggccagctggtactggatttataccaaaataatggacttcattgcaattcaaaccaagatatgtcggacggttaccagaggagaaggactcagtcctactgaaagctgtgaaggattgggagatcttgcttgcttctatgttgctgtaatttttattttaaatggactaatgatggcattattcttcatatatggcacatatttaagtggcagccgattaggaggcctggttacagtgttgtgcttctttttcagtcatggagagtgtacctgtgtaatgtgganaccacctctccgcgaaagcttctcatatccatttcttgttcttcagatgttgcttgtgactcatattctcagggctacaaaactttatagaggaagtttgantgcactctgcatttccaatttatttttcatgcttccttggcagtttgctcagtttgtacttcttactcagattgcatcattatttgcagtgtatgttgtcgggtacattgatatatgtaaattatggaagatcatttatatacacatgatttctcttgcactttgttttgttgtgatgtttgggaactcaatgttattattatgctgcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacatggagtttcactcttgttgcccaggctggagtgcaatggtgtgatcttggctcaccgcaaccttcctctcccaggttcaagcgattctcctgcctcagcctcccgagtagctaggattacagtgaccgcccacccgcacctgctgaacagcaaggtccacggagtaggaactgaacgtgtcagggactatgtgtggcactgtatggcaagtctccaagactgggaagcaccgctttacatagtcctcatggattccaaagcatgagttgggctgcttttgaatagtgggagacgggagtttaccccgatcacagaaaccataccaactgaaagacaaatcagcatcttgctggacgacccctcacagagctcctagatccttgaagtgtgaacttcagcagctgagagagatggggtctcactatgttgcccaggctggtcttgaactcctggactcaagcaatcctctcacctcagcctcccaaagtgctgggattacaggtatgagccactgcattcggcccaatttctttaatagataatagggctattcatattttctttttgcaactgtgttggtaatgcgaatctttaaaaaaatttgtatatttcatttatgttgttaaactggttagcataaagttgttcacaatattcccctattttctgttcttttaatttctgtaagagctacagtaatgtccctctttcatccctaatgttggtaatttgtatcttctttctttttatctttaccagattttataaatattgttgatctttttgaaaaaccaactgttggcttcattttctttattgtgtaatactaccttagaggacagcagttcctaatacctacttttattatgagtctctgccatttataaagaactgtggacagcacagggaatgggggaagaaaactctggtgcagcttgaatcttggtagcaaaacagtgacttcatcagaaaattttgtcactctctattagatataatggagtttgaccatttggaatttggaatttttcaaatgaatatgacaaaaatttaaaaaactcttgtattactatgtgataacacagatctttacaactttatgtttgttttatcaattacatattaaagatagaaaatggaatgtgttg

SEQ ID NO: 288701 - DNA, 1583 bp, Homo sapiens
  misc_feature (2)..(2): n is a, c, g, or t
  misc_feature (207)..(207): n is a, c, g, or t
  misc_feature (558)..(558): n is a, c, g, or t
  misc_feature (660)..(660): n is a, c, g, or t
  misc_feature (1056)..(1056): n is a, c, g, or t
  misc_feature (1117)..(1117): n is a, c, g, or t
  misc_feature (1124)..(1124): n is a, c, g, or t
  misc_feature (1126)..(1126): n is a, c, g, or t
anacagtactgtgctgctttttcaaccatggagaggtcacccgtgtgatgtggacacaacctctccgtgaaagtttttcctatccattccttgtacttcagatgtatattttaactttgattctcagggactgtattattcctatttcaagactattgtggaaacaccctcatttttgaatggagtatggatgattatgaatgatanactgactgaatacccccttgttattaatacattaaaaagattcaatctttaccctgaggtaattttggccagctggtactggatttataccaaaataatggacttcattgcaattcaaaccaagatatgtcggacggttaccagaggagaaggactcagtcctactgaaagctgtgaaggattgggagatcttgcttgcttctatgttgctgtaatttttattttaaatggactaatgatggcattattcttcatatatggcacatatttaagtggcagccgattaggaggcctggttacagtgttgtgcttctttttcagtcatggagagtgtacctgtgtaatgtgganaccacctctccgcgaaagcttctcatatccatttcttgttcttcagatgttgcttgtgactcatattctcagggctacaaaactttatagaggaagtttgantgcactctgcatttccaatttatttttcatgcttccttggcagtttgctcagtttgtacttcttactcagattgcatcattatttgcagtgtatgttgtcgggtacattgatatatgtaaattatggaagatcatttatatacacatgatttctcttgcactttgttttgttgtgatgtttgggaactcaatgttattattatgctgcttctttggtaattatttggggtattctggcaatgaaaccacatttcctgaaaataaatgtatctgaacttagtttatgggttattcaaggatgtttttggttatttggaactgtcatacttaaatacttgacatctaaaatttttggtattgcagatgacgctcatattggcaacttactaacatcanaattctttagttataaggattttgatactttattgtatacctgtgcagcggagtttgactntatggananagagactccactgagatacacaaagacattattgcttccagttgttcttgtagtgtttgttgctattgttagaaagattattagtgatatgtggggtgtcttagctaaacaacagacacatgtaagaaaacaccagtttgatcatggagagctggtttaccatgcattgcaattgttagcatatacagcccttggtatattaattatgagactaaaactcttcttgacaccacacatgtgtgttatggcatcactgatctgctcaagacagctatttggatggctcttttgcaaagtacatcctgttgctattgtgtttgctatattagcagcaatgtcaatacaaggttcagcaaatctgcaaacccagtggaatattgtaggggagttcagcaatttgccccaagaagaacttatagaatggatcaaatatagtaataaacacagaatgcgccag

SEQ ID NO: 288702 - DNA, 947 bp, Homo sapiens
  misc_feature (2)..(2): n is a, c, g, or t
  misc_feature (207)..(207): n is a, c, g, or t
  misc_feature (558)..(558): n is a, c, g, or t
  misc_feature (660)..(660): n is a, c, g, or t
anacagtactgtgctgctttttcaaccatggagaggtcacccgtgtgatgtggacacaacctctccgtgaaagtttttcctatccattccttgtacttcagatgtatattttaactttgattctcagggactgtattattcctatttcaagactattgtggaaacaccctcatttttgaatggagtatggatgattatgaatgatanactgactgaatacccccttgttattaatacattaaaaagattcaatctttaccctgaggtaattttggccagctggtactggatttataccaaaataatggacttcattgcaattcaaaccaagatatgtcggacggttaccagaggagaaggactcagtcctactgaaagctgtgaaggattgggagatcttgcttgcttctatgttgctgtaatttttattttaaatggactaatgatggcattattcttcatatatggcacatatttaagtggcagccgattaggaggcctggttacagtgttgtgcttctttttcagtcatggagagtgtacctgtgtaatgtgganaccacctctccgcgaaagcttctcatatccatttcttgttcttcagatgttgcttgtgactcatattctcagggctacaaaactttatagaggaagtttgantgcactctgcatttccaatttatttttcatgcttccttggcagtttgctcagtttgtacttcttactcagattgcatcattatttgcagtgtatgttgtcgggtacattgatatatgtaaattatggaagatcatttatatacacatgatttctcttgcactttgttttgttgtgatgtttgggaactcaatgttattattatgctgcttctttggtaattatttgggtaaatattccttacttatttggctgtttttgaaattaatggtttaacaatttcttcttc

SEQ ID NO: 288703 - DNA, 642 bp, Homo sapiens
ccccacctccccccacccccgaacctcacggccaccctgggaaggaggcttgacttgtgacatccacccctcttcacggctgaggaactttggccccgagcgaggaagcgaccggcccacggccacacgcccggagtggggggcagcatcttctactatgtgcatctacattggatggcagtggagcaacacagattgttttctgacaaaaatcagccaagtactaggagaggcaggactttagaagtggaggagatggagaaggaagcttaggttactatggagtgtgcaaaaaggtcctgtggatttagataccaccacacacaaatgctgttgttggaaggtacctgcccagataaggactgcatttcctctagcatccagatgggaccaaatgactgctggccaatagaagtgagtggaaaggactgactccagttccaggttgggcctccaactgctctgggcacgtcgatggaacagaacaccacctccaccccaataccaccaattcaactttacatgaattataagcgagaaataacttggactgtgttaagtcattgagtttctggggtttaactgttattatagttaagaatgactttaactaatatagtcaatgacatctaaaaggagtta

SEQ ID NO: 288704 - DNA, 457 bp, Homo sapiens
ccccacctccccccacccccgaacctcacggccaccctgggaaggaggcttgacttgtgacatccacccctcttcacggctgaggaactttggccccgagcgaggaagcgaccggcccacggccacacgcccggagtggggggcagcatcttctactatgtgcatctacattggatggcagtggagcaacacagattgttttctgacaaaaatcagccaagtactagaagtgagtggaaaggactgactccagttccaggttgggcctccaactgctctgggcacgtcgatggaacagaacaccacctccaccccaataccaccaattcaactttacatgaattataagcgagaaataacttggactgtgttaagtcattgagtttctggggtttaactgttattatagttaagaatgactttaactaatatagtcaatgacatctaaaaggagtta

SEQ ID NO: 288705 - DNA, 392 bp, Homo sapiens
ttattcctttacagtctcatctcccctaacctccttcataaactccacacaaactctagacatcctgatctgttatgtaagtattctaggttcttttgtgcttcagcatatgttctacctaggatgcccttctctcctttatccatgtgaatgattcctactcttccttcccagcttagatcaaacagtcagttctaaggagaaccttctctactccacttttctctcccttctctaacaacagtatccccatcccacccccattcaggagtttctttcttcatattcacattattccttgtatttactgcatggcattttaatatctgccaagagcaagggctgtgaagtcagactgcctgggtgtaaatctgggcccagaatttactatg

SEQ ID NO: 288706 - DNA, 2876 bp, Homo sapiens
  misc_feature (2876)..(2876): n is a, c, g, or t
cctgcggcgggctttagggagtggtccctggctgtggatagatctgctgatgagtccaggccccggtccattctcctcgcgctgcaaggatgctcctgggatttcggagaggccgcaggagtcatttcaaacagggtctcgctctgtcgcccaggctagagtgcagtggtgcgatcatagctcactgcatcctcgaactcctgggctcaagcgatcttcccaccccagcctcccgaggagctgagactacaggcgcgcgccactactcccggctaattgttcaatatttttgtggaaacagggatcttgctatgttcctatggtggtcttgagctccttagcctcctaaagtgttggtatcacaggcgtgagccactgtgcccggcgttaacaatcttctgccccagggtcggccacagttggacaggagcaccctgcctcccctgtagcattcgtccccgtgcccggagttaactcctggacgacgtacacctgctgcactgctggatatagccattcttcatttttccctcctccacccaccatgtacaccccatcagcaagtcccatccgatatacccactacatacatctgccagctgttcccatctccacccacaccccggcctccagcatctgtctggactgctgcggcagatcctcactggtttctctgcttccactctcgcccttcccctaggtccattctccacgtagcagccaaggggattcttatatttatttattatttaatttagttttagagacagggtcttgtcctgatgcccaggctggagtacagtggcatgatcatagctcactgtggcttcaacctcttgggctcaagtgatcctcctgcctcaggctcctgagtagctgggactacaggtgtgcaccaccacacctaggtattttttatttattttattttttgcctcacactctgccaagtctcaatgcctggctaattttaaaaattattttgtagaggccacgtgaggtggctctcacctgtaatccagcactttgggaggctgaggcaggcggatcatttgaggtcaggagttcaagattagcctggccaacatggtgaaaacccatctctactaaaaatacaaaaattagcgggcgtggtggtgggcacctgtaatcccagctacacgggaggttgaggtgggataatcgcttaaacccgagaggcagaggttgcagtgagccaagattgtgccactgcactccagcctgggcgacaaagctagactctgcctcaaaaaaacataattttttttttttggtagagatggggtctgggtatgctgcccaggctggtcttaaaccttggctcaagcaatcctctcaccttggcctccagagtgttgggattacaggtgtgagccactgcatctggcttgagtttttatttaaagccccaaacattaatgagtccctgctgtgtgctgatacccacaactgacagcttatggccacacggtctgtaggatagacaagcccataaataattctgtacacaatggtaaaacaagaactgctgttgatgtgtgtaccagaagggcagtgacgtcagcctggagagttggcctgggcctggcagggagtaaggaaagaattctgggtgcagaagacagcaaataccaaggcctaaaaaagaatgaattatttgctgtttgggaaatggaagcccacgctgagtgctgaagcacagggactctgcgcaggaagaggaggggaagcaagaaatgaatttgggtccttgtgatggcagtggctgctgccatcacgctgtgtggctagggctgcacacttcatggagccggtggaagccccgtccctcatgagttgggactggagccgcaaaccgctgctgcagacccaggccttctgctctatggagcaggcaggagccccaccctcttgggcagggctacagccacccaaactgcagctgtggatccgagcctctctgctcctgggggagccgggaacaggcagaatttgcccttccagatgcagctgcagccgcgcaggcaggagccagggacaagtgggagccctgcctcttccaagttggcggggtgggagctcccaggtgcagctgtggctgcccccccaggcacaggacgagggcatctctgtagcctgcaccatcggccatcccaggaaggacagcccccttcaccctccatccctgcaggctcaggggtgtctgcttccactgcctggcctctctccactccagcaactgctctgatcttggaggggagtcggagccaagacctgcagccatgaatggcagcaggaggaagggggtggggtccccagtaaggccccaccctcaggccagggagggcctgaattctgggggctgggctgccagtccctctgaccagagtggaaactcgtggagccttttctgggcctgccaatggcccaatcagcacacacttcttccccgctgaggtccataaaaaccctgggctcagccagagcagcgcagagaatagccagaggatgaagatggtagagacgaggggacaggatgaccagctgcagagagcagtaccctctctgctgatagctggagacggtggggtgaccagctacagagaggagtaccttctccgctgaaagctacagagaccacctgccagcagagaggagctacactctgctgcgagcttcagagacctgcagagacattggaatgacttgcctgcggagaggagccactctctccagggcctcctctctgttgagagctgaatgattgagctcatgggacaatctgtctccagagaggagctacccactcctctgagctcttctaacactaaataaaactcctcttcacccttcan

SEQ ID NO: 288707 - DNA, 506 bp, Homo sapiens
ctgtgcgtgagctctgggggccttttcttgtttggtcaaaaaaaacaaggtgctgctgctgttcatgccctctaagttgtacaaaccttttctgccctctcccctagcccttctctatcctcctgagcaagtactttattctcttttgtttagttgttacttttgtttgtttgttttgagacagggtctcactctgttacccaggatcgcttgagcctgggaggttgaggctgcagtgagctatgatcatgccactgcactccagcctgggcaaccaggtgagaccctgcctcaaaaataatacaataaaaagtaaaagcagccctggggaaatggagacagtggacaaagcaggctggggcaccaggtgtgcatgtgggtgtgagtctgtcatgagagctgtcctgaatgcccttaacgccactgaactgtatgctggaaaacagtgacaacagtggattttgttatatagacaattaaaaaagaaataacacccaggcctgctt

SEQ ID NO: 288708 - DNA, 506 bp, Homo sapiens
ccaggatgccaaggagggcggggcaggcaaggcagagaggcacctgggtgcttgtgagattccaggaaaggacagaaacattggggtgcttctgggaggaactggcacgccccggcccttgcagagtggacaaggtttcaggagctacagaagggtggagagggcccccaggagcacagcaggcactcagagcagcaggagggggatcgcttgagcctgggaggttgaggctgcagtgagctatgatcatgccactgcactccagcctgggcaaccaggtgagaccctgcctcaaaaataatacaataaaaagtaaaagcagccctggggaaatggagacagtggacaaagcaggctggggcaccaggtgtgcatgtgggtgtgagtctgtcatgagagctgtcctgaatgcccttaacgccactgaactgtatgctggaaaacagtgacaacagtggattttgttatatagacaattaaaaaagaaataacacccaggcctgctt

SEQ ID NO: 288709 - DNA, 2744 bp, Homo sapiens
cctgcggcgggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcgaccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagagagcttaaatattgaaggcctcccatccaagggccctataccaccctggttgttggatataaagtacctgtcaccattgttgctggcttatgaagatatgatgaaagagaaggacgagctcaatgccaccctcaaggaggaaatgagaatgtttaggatgcgagtccaagaagtggtgaaagaaaatgaagaattgcaccaagagttaaataagagtagtgctgttaccagtgaggaatggcgtcagcttcagactcaagcaaaactggttttagaggaaaacaagttgttgctggagcagttggagattcagcaaaggaaagccaaggacagccaccaggagcgcctccaagaagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaattacagaaggaagaagagaaagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaacgaaatgtctgctcatcagtacctggcaaaccttgttggcctggcagaaaatataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctgcagcagaacagagaaatggaaggtgaacttgaagttatttgggaatctaccttcagggaaaaccgaagaatccgagaacttctccaggacacactcacgaggacaggcgtgcaggacaaccccagagctctggttgcccccagcctcaatggcgtctctcaggcagacctgctggacggctgcgatgtctgctcctatgacctgaagtctcatgcccccacctgctagaatctgcgggagcccgtggtgtagcctcctctggcctgaaaggtctgcctcacacaggccttccctgcagggcagcccatggtggcagccggaggtgcgtaagcccactgaacgctgcagggcagggaagaaataaatggtctcatagtttaatccattgataacattttgctttattttttaatttttttttttttttagagctagggtctcactctgttgcccatgctggagtacagtggtgcaatcatagctcacggcagcctcaaacatgtttgagatccttctgcttcagcctcctga

SEQ ID NO: 288710 - DNA, 799 bp, Homo sapiens
ccaggatgccaaggagggcggggcaggcaaggcagagaggcacctgggtgcttgtgagattccaggaaaggacagaaacattggggtgcttctgggaggaactggcacgccccggcccttgcagagtggacaaggtttcaggagctacagaagggtggagagggcccccaggagcacagcaggcactcagagcagcaggagggggtttggtcagagcttgggtgggaaatgaggccggactgcacagaggagaactgggtctgctgggaggggctcctccttccccatgctgcaagtgtctggtctgagcagggaacccttctctttcttggtcctggtgaggtttcatacggcattggaagattcctggtcaagcagctgtagaacatgacccaggcacgcgagtgagccttgctggctttgccattatttaaaagcagccctgggcatggtgatggcgcctatggtttcagctactcaggaggctgaggtgggaggatcgcttgagcctgggaggttgaggctgcagtgagctatgatcatgccactgcactccagcctgggcaaccaggtgagaccctgcctcaaaaataatacaataaaaagtaaaagcagccctggggaaatggagacagtggacaaagcaggctggggcaccaggtgtgcatgtgggtgtgagtctgtcatgagagctgtcctgaatgcccttaacgccactgaactgtatgctggaaaacagtgacaacagtggattttgttatatagacaattaaaaaagaaataacacccaggcctgctt

SEQ ID NO: 288711 - DNA, 961 bp, Homo sapiens
  misc_feature (961)..(961): n is a, c, g, or t
cctgcggcgggctttagggagtggtccctggctgtggatagatctgctgatgagtccaggccccggtccattctcctcgcgctgcaaggatgctcctgggatttcggagaggccgcaggagtcatttcaaacagggtctcgctctgtcgcccaggctagagtgcagtggtgcgatcatagctcactgcatcctcgaactcctgggctcaagcgatcttcccaccccagcctcccgaggagctgagactacaggcgcgcgccactactcccggctaattgttcaatatttttgtggaaacagggatcttgctatgttcctatggtggtcttgagctccttagcctcctaaagtgttggtatcacaggcgtgagccactgtgcccggcgttaacaatcttctgccccagggtcggccacagttggacaggagcaccctgcctcccctgtagcattcgtccccgtgcccggagttaactcctggacgacgtacacctgctgcactgctggatatagccattcttcatttttccctcctccacccaccatgtacaccccatcagcaagtccataaaaaccctgggctcagccagagcagcgcagagaatagccagaggatgaagatggtagagacgaggggacaggatgaccagctgcagagagcagtaccctctctgctgatagctggagacggtggggtgaccagctacagagaggagtaccttctccgctgaaagctacagagaccacctgccagcagagaggagctacactctgctgcgagcttcagagacctgcagagacattggaatgacttgcctgcggagaggagccactctctccagggcctcctctctgttgagagctgaatgattgagctcatgggacaatctgtctccagagaggagctacccactcctctgagctcttctaacactaaataaaactcctcttcacccttcan

SEQ ID NO: 288712 - DNA, 586 bp, Homo sapiens
ggggatgtcagtgcccgggaggacagaggaggccacagtgatgacctgtacgctgtgccacacagaaatcaggtgttttctatgttcccagttttcttcttgacattcaccctgatgttaacttttggtaaattagtgcattgctaaggatttcttctctctattctgcatttgatagcatttgctttggggcttatttttttaaacgtgtccagcctcatttctatctggttagattaaaacataaacttctttcctttatcttgcaaaaacaaagattaacatcttcatattgttaatgtggagttccattcacagcttagcaatctcgttcttttctttgaccttggaagctaaatttcctatcacttttatggtatcattttgcacactgcagcctttctttaaattcatgcctgacggggaagatcgtcatgcgtgtctcaatgggagctgacgtgctttgagtgtttactgtgagcgctcccgtttctaactcctgtgtgcatttatcttagctgacccccactgactcgctgaggaattcccttcattgccctgtcacacatcagggcactgcacacag

SEQ ID NO: 288713 - DNA, 2852 bp, Homo sapiens
cctgcggcgggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcgaccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccaggtcccacattgttacaagatctttggggtgtcgcttttctggtcggaaatgtctgtggtgccagtgtgcctttgcctgagttcttgtcctgcgtccagaaagaatgagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagagagcttaaatattgaaggcctcccatccaagggccctataccaccctggttgttggatataaagtacctgtcaccattgttgctggcttatgaagatatgatgaaagagaaggacgagctcaatgccaccctcaaggaggaaatgagaatgtttaggatgcgagtccaagaagtggtgaaagaaaatgaagaattgcaccaagagttaaataagagtagtgctgttaccagtgaggaatggcgtcagcttcagactcaagcaaaactggttttagaggaaaacaagttgttgctggagcagttggagattcagcaaaggaaagccaaggacagccaccaggagcgcctccaagaagtttctaagctgactaaacaactaatgctcctggaggcaaaaacccacggccaggaaaaggagctggcggagaacagggaacagctggagattttacgtgccaaatgccaagaactcaaaacacactcggatggcaaaatcgcagtggaagttcataaatcaattgtgaatgaattaaaaagccaattacagaaggaagaagagaaagaaagggctgagatggaggagttgatggagaagctgacagtcctgcaagcgcagaagaagagcctgctgttagagaagaacagtttgacagagcaaaacaaagcactggaagccgaacttgaacgagcacagaaaatcaataggaaatctcaaaagaaaattgaggtcctcaaaaagcaggtggaaaaagccatggggaacgaaatgtctgctcatcagtacctggcaaaccttgttggcctggcagaaaatataacccaggaacgtgacagtcttatgtgtttggcaaaatgtttagaaagtgagaaggatggagtgcttaataaagtcataaaaagcaacattcgcctgggaaagttagaggaaaaagtcaagggctacaagaagcaggcagcactgaagctgggggacatcagtcaccgtctgctggagcagcaggaggacttcgccggcaagacagcccagtaccggcaggagatgcggcacctgcaccaggtgctgaaggacaagcaggaggtgctggaccaggcgctgcagcagaacagagaaatggaaggtgaacttgaagttatttgggaatctaccttcagggaaaaccgaagaatccgagaacttctccaggacacactcacgaggacaggcgtgcaggacaaccccagagctctggttgcccccagcctcaatggcgtctctcaggcagacctgctggacggctgcgatgtctgctcctatgacctgaagtctcatgcccccacctgctagaatctgcgggagcccgtggtgtagcctcctctggcctgaaaggtctgcctcacacaggccttccctgcagggcagcccatggtggcagccggaggtgcgtaagcccactgaacgctgcagggcagggaagaaataaatggtctcatagtttaatccattgataacattttgctttattttttaatttttttttttttttagagctagggtctcactctgttgcccatgctggagtacagtggtgcaatcatagctcacggcagcctcaaacatgtttgagatccttctgcttcagcctcctga

SEQ ID NO: 288714 - DNA, 1330 bp, Homo sapiens
cctgcggcgggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcgaccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagatggtaaacaccctgttctgaatttaaaggatgaaaaacctccattatgtgagaaacctccaccctccccagatataactggtagagcacgtcaaagatatacagaaataaccagagaaaagtttgaggcattaaaagaagaaaatatggacctaaacaatatgaatcaaagccttacccttgaactaaacacaatgaaacaagcaatgaaagaactacagttaaaacttaagggaatggaaaaagagaagagaaagctcaaagaggctgagaaggcgtcgtcacaggaagttgctgcacctgaattactttatctgcgaaaacaagctcaagaactggtggatgaaaatgatggattgaaaatgactgtccatcgtttgaatgtagaactcagtcgatatcagacaaaattcaggcatttgtccaaggaagaggtaacgtttccgattgtgaaaatcagcttttcagatttttaagcctttactgttgaattgatttccaatcttgagaggttcttatttattataatttgatgtaagaaaagctctgtccaaggcacaatgtttctaaggaccattctgtttcttgcctccttcccttccttcttccccgtaataaaggcaataaagactgttaaacattggga

SEQ ID NO: 288715 - DNA, 915 bp, Homo sapiens
cctgcggcgggctttagggagtggtccctggctgtggatagatctgctgatgagtccaggccccggtccattctcctcgcgctgcaaggatgctcctgggatttcggagaggccgcaggagtcatttcaaacacatcatccatggccttttacctgcagccagcgttgctccgaaggcagctgtgccacgcacacctcctccccgcagccccaacccatctccagagagaccaagatctgctctggcagcagccattctggcgacaacattgactgggcggacggttgctattcctcagcctcgccagaggtcccggtctgagagtgatgtgagcagtgttgaacaggacagcttcatcgagccctatgccaccacctcacagctgaggcctcgaccaaattggcagagtgagatgggaagaagatcttctttgccatcctttgaaacactggactatggggacgaagaggacattgaaactcagctgtcatccagcggcaaggaattgggggatgtcagtgcccgggaggacagaggaggccacagtgatgacctgtacgctgtgccacacagaaatcaggtgccattgttacatgaggtgaacagtgaagacgatgaaaatatttctcatcaagatgggtttccaggctcccctcctgcaccacagcggacacaacaaaaagcaggtgagaccctgcctcaaaaataatacaataaaaagtaaaagcagccctggggaaatggagacagtggacaaagcaggctggggcaccaggtgtgcatgtgggtgtgagtctgtcatgagagctgtcctgaatgcccttaacgccactgaactgtatgctggaaaacagtgacaacagtggattttgttatatagacaattaaaaaagaaataacacccaggcctgctt

SEQ ID NO: 288716 - DNA, 2271 bp, Homo sapiens
tgcggcagcaatatgagctaggtccggatcctgttagacaccggcgggcgcgagccgttgcaggtacctgggggtggttaagttggtgacatggctcagaagtttatttctttaaatttttaagttttttttctttttagtcttcagaaaggcaacagtagtcttttaacgtcactgttaaaagtgtaagactcttttactccctgagagtcccctttccctttcttgcgtcctttcctctttattctttttttttttttttttttttttactgagacggagtctcactctgtcgcccaggctggagtgcagtggcgcgatctcggctcactgcaaactccgcctcccgggttcaccctttctctttattcttatcccggtcagactcgccccctcctccaagacatctctctgttttattttatttgattttagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttctttccttttacctccataagaatagggaaagtagaacaagaaaaaattgaactccttccatttctaaataaagtttgggaga

SEQ ID NO: 288717 - DNA, 2142 bp, Homo sapiens
tgcggcagcaatatgagctaggtccggatcctgttagacaccggcgggcgcgagccgttgcagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttctttccttttacctccataagaatagggaaagtagaacaagaaaaaattgaactccttccatttctaaataaagtttgggagaaaaaaggacaccaagtaatgtagcatttaaaatttagaaatatttacatccgtcatctcatcccagattcaagaactcatctgttaagtttctcgggcacaagctgttacttcaacacatatgctataaaaacactcttgttcacaacttagctttcttcactcactccagatttcttgccccactgacgtggcataaataataaaaacacaaatattgtgttcagtacaacacaaaagagca

SEQ ID NO: 288718 - DNA, 2049 bp, Homo sapiens
tgcggcagcaatatgagctaggtccggatcctgttagacaccggcgggcgcgagccgttgcagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttctttccttttacctccataagaatagggaaagtagaacaagaaaaaattgaactccttccatttctaaataaagtttgggagaaaaaaggacaccaagtaatgtagcatttaaaatttagaaatatttacatccgtcatctcatcccagattcaagaactcatctgttaagtttctcgggcacaagctgttacttcaacacatatgctataaaaacactcttgttcacaacttagctttcttcactcactccagatttcttgccccactgacgtggcataaataataaaaacacaaatattgtgttcagtacaacacaaaagagca

SEQ ID NO: 288719 - DNA, 1721 bp, Homo sapiens
tgcggcagcaatatgagctaggtccggatcctgttagacaccggcgggcgcgagccgttgcagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaattggctgagtgggtaattagaacgagatattcaccacacttgtagatcgcatatctacacttgcgcccatcattgggg

SEQ ID NO: 288720 - DNA, 473 bp, Homo sapiens
aactaatacctattctgcttagtgacctgtccctaagtgtcatccattctttcctcctttgaatatgataccaaggaagaagaatcaagcaaaaggggaaagtaattaaaaaaaaaaaaatatcaaagcctgtttggtttcatgtttcagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttctttccttttacctccataagaatagggaaagtagaacaagaaaaaattgaactccttccatttctaaataaagtttgggagaaaaaagga

SEQ ID NO: 288721 - DNA, 2373 bp, Homo sapiens
tgcggcagcaatatgagctaggtccggatcctgttagacaccggcgggcgcgagccgttgcagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaaaaaaaaaaaaaaaaaaaaaacaaaaaaaaaaggggggcgcgcggcgcccaaaaaataccccccggggggcgcccaaggtttcacgcgcgtgtccccaggttttcctgtggtcacaaggggcgcccctaaaggggggccgatattaaaacgctaggcgcatctgggcgcagctgtgtttaaacacatcgtccgtgagctgcggagaagacacgtcgtctcacttgggagagaccttgggtgagaaggagacccccttactttcgcgggcgcgtgggcagacccataattgggggacaaatttcctctcaaaggaggatgtaaacggtctccaaaggcggagaactatcatagacactttttcatagcgcgctaacacgcggcgtgttcaaaacaccaagaccgcggccaaatagtgccatctgccgcgcttgtgaaacaaagtttcggggcgctcaacgcggggagcatagtacatctctcgtcgcacacacatttttttatcccccgcggggagcccgtcgtgtcttaattataccgggcacgcatataacaaccatcacagcccacatccaccagccactcaccatcc

SEQ ID NO: 288722 - DNA, 1979 bp, Homo sapiens
tgcggcagcaatatgagctaggtccggatcctgttagacaccggcgggcgcgagccgttgcagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttctttccttttacctccataagaatagggaaagtagaacaagaaaaaattgaactccttccatttctaaataaagtttgggagaaaaaaggacaccaagtaatgtagcatttaaaatttagaaatatttacatccgtcatctcatcccagattcaagaactcatctgttaagtttctcgggcacaagctgttacttcaacacatatgctataaaaacactcttgttcacaacttagctttcttcactcactccagatttcttgccccactgacgtggcataaataataaaaacacaaatattgtgttcagtacaacacaaaagagca

SEQ ID NO: 288723 - DNA, 974 bp, Homo sapiens
  misc_feature (844)..(845): n is a, c, g, or t
tgcggcagcaatatgagctaggtccggatcctgttagacaccggcgggcgcgagccgttgcaggtacctgggggtggttaagttggtgacatggctcagaagtttatttctttaaatttttaagttttttttctttttagtcttcagaaaggcaacagtagtcttttaacgtcactgttaaaagtgtaagactcttttactccctgagagtcccctttccctttcttgcgtcctttcctctttattctttttttttttttttttttttttactgagacggagtctcactctgtcgcccaggctggagtgcagtggcgcgatctcggctcactgcaaactccgcctcccgggttcaccctttctctttattcttatcccggtcagactcgccccctcctccaagacatctctctgttttattttatttgattttagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaacgtaaaagatgcagttcttaaagacctcggtgatctaatagaagccacaggatttgataggttatttgaggggactggtgcacggctccgcggaatgccggagacactggggcaggtagcaaaagccctggagaagtatgcagccccctccaaggaggaggaagggttgggtnntcccccattttggctttcccccaaaaatgggggaggccgcggggggcctcctccctttaggggatcctgaaaaaagggtgggttttaaaccgagggggataaaagtgtttcgtggggccaacacctagt

SEQ ID NO: 288724 - DNA, 420 bp, Homo sapiens
tacccataggataaggtccctgacacaatgatgatggaaccatgatcctatcttgcctctgtcacagtcatgtttcccacctgccacctgtgccaattcaggtcacaggcaattcccaaatcacggtttgtttagtgtcactgccattgcttatgctcactgtacctagaatgcctccttgtccccactgttttaagttaaattctctgaatccttataaagcccagctcaaatatactcccaccacaattttcttctgtcttaccagctacaagttcattttatttcctctgaaattctatggaatttgttaccttataacatttattacatattttctttttttttttaattttccgagtgaacatcattaacacaatattttcgtttttcttttcttcctttcctttttatattctt

SEQ ID NO: 288725 - DNA, 696 bp, Homo sapiens
gaacattacatcttaacgtttagctcttagaatctgaccttttcctcaagtttgggaggcatcttattcactataatttccaagtattcacattgtctccttctgaaacgaagggaagtgttttaactgtgcaccacaaatcacaatgtaagatgccacctgctgtccatcactctgcagagccagccacttccaacatgaacatactaatttattcatttatcaataccacaaagctcgctctctgagccagtcactcttgcctcgaccgagctgctagcagctctggggaaggcaggaccaaatggcaatggagaacgggctgcggcttctcacagggtggggcgggcctggtgcaccctccccgagagcactggagaagggggtgcagtttctcacagggtgggcaggcctggtgcaccctcccccagagcactggagaagggggctgcagtttctcaaggcgggggcaggcctggtgcaccctccctgagagcacgggagaagggggccacggcttctcacagggtggggcgggcctggtgtaccctccccgaaagcactggagaagggggccacggcttctcacagggtggggtggccctggtgcaccctccccaaaagcactggagaaggggccatggcttctcacagggtggggcgggctggagagcactggagaagggggcggcggct

SEQ ID NO: 288726 - DNA, 713 bp, Homo sapiens
gaacctaaagtgtaaggaagaatgggagaaaggtgagtgaaatcagtagaaattattgatatcatctcacattcctttgttgattcacacagacgctggaacactcaggtacatgggcctcacacccatgcacataccctccatcaccaaacacatatatgtctacatacgtacacaggaacacgggattacacaagtggataacacctacctcctacccaagacacaacagagatttaaaaataataatggagacatgctgactggcatgctgattggcatgtgtcctgcatgtctgtgtgctggacttgggacagagtatggcaatactaaccagacacctaaaatctattcttgcgacctcaagcatgtatctccttgtagcaaattcgtgcagtttcatgtttgtgtagcttttactgacttcattttaattgtttttctctgccagcggtctctttgttagtatccatgattgaaggcatattgcttcagttctcaaagcatggccagaagatgtcatcaaggtaagttatcacgtttttcccctatggcaaatttgttttctttgctgtcccataaaatagtttaaaacatactgacaattctcatgataataggtagcattcattagcttttctagtgaatatcacctaatttatatctctttgaattttacatagtgggttattaaaggcaattgtaaaaaaaaa

SEQ ID NO: 288727 - DNA, 893 bp, Homo sapiens
tcattcggagaccctggaaccttccacctagtggctatgccctcttctggtgcttcaaagccatataatggattctctggatctggctaacagcggtctctttgttagtatccatgattgaaggcatattgcttcagttctcaaagcatggccagaagatgtcatcaaggtataataaaaagaaaatactgaggttctcaaaaaaatggactgcagtataagagtattataaaaaccacccatgaatatatttgaaatcctagatgaaatggatcaattcctagaaaaatacaaacacaagaataaatagaagatttaagcaaaacaataaaactaaagaaatggaaatggtggtcaaaaaccttaccactcacagatgttcatacaaaacccagatggttttacagataaagacaaagataaactggtggttctcaaccaaatgccaatcttaaaaaggcttcaccctgaagttacatacctcaacaagtccctgcagtattctgacaaagatgacacatccataatgcactctggctgctgatggaattagcatatttagggtagaggtaagaagtatggcagctccgaaaaccctgaaatagaaaagatgagaacactgtttaaatgattcagcatcttatatatacatatctaaatttctcaggagaagtgaaacatttaaagtaataaaaaaatcgccaataattttaaggtagattgttttttctaatatatgttctggacttaacaggctagccattgtgaatatatacatgggccatctagaaattctatatttgatgcttcaaaaaataaaaggtagtaggcgcgcctacgctttctttgtttattcgtttggtgttacgtctctggtggtcgaattactgtgc

SEQ ID NO: 288728 - DNA, 646 bp, Homo sapiens
gcagtgatacaatcacagcttactgtaaactcaaactcctgggctcatatgatcctcccatctcagcctcctgagtagcaaggaccacagtcaatcttttgtcaagtaaggaaccacatctctagctgggtgtggtagctcacacctataatcccagcactttggaaggctgaaggaggaagattgcttgaagccaggagtttgagaccagcctgagcaacaaagcaagaccccagctccacattttttttttttaaattagccaggcatggtggtgtatgcctgcagtcccagctacttgggaggctggggcaagaggatcacttgaacccaggagagttcgaggctgcagtgagccataatagcaccactgtgcactccaccctgagtgacagagcaaaatgctgtcaaaaaaagaagaaaaaaaaaagaaactacatctcctgggactgctgcaaaaaatacatatggattgattctattaagtcaatactaacagagactccgagtcagatattagagttttacagttaaataaatctaaccaatccttactgaggctagaatccttttaggcaaaaaatgtaacagaatacatccatggaaaaagatagtgtgtaaaaataaaattcatctgtaaaggaaa

SEQ ID NO: 288729 - DNA, 227 bp, Homo sapiens
tgcagaggtctcatcaaacgcctggtctgcctgcaccatgcagcctggaagcccctgacccatcgccagctcctaccgtcacccgtgaggtccaatatggtgtcgtcctcccctcgatcgtcagaaaccatcgctctgtaaattcccttgtcctttttggacaactggaaagaaggatgagcgatggtggtgtcagcatgggctccagaaggagagatggataccaa

SEQ ID NO: 288730 - DNA, 438 bp, Homo sapiens
agtcgctgcgtttggtcagttgcaccttctgggtcactggtagccgcgggagccgggtggggcctaggcgatgatccggcattaaggagctgggatcatcctccgtctcaggtggtttggggaaagtgtaggggcaaccaaagatcatcggcttgactaggccctttgccctgaacctcatgaagaaatgataggaggcagacatatgtgcctaaaaagagcgttgagctcagagaagagcaactcggagttttgggggtgtgctttgatttgtgtacatcaatggcagaatcatccagcgaatcagatcacttccgctgtcgtgaccgattgagtccatgggctgccagatcaacgcacaggggaactcgaagtcttcctacagtagaagttaccgagaaggtcaacactataacaagtactttacaggttagttta

SEQ ID NO: 288731 - DNA, 2095 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288732 - DNA, 2137 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggtgttcctcccacctcggcctcccaaagtgttgggattacaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288733 - DNA, 1864 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288734 - DNA, 1947 bp, Homo sapiens
gaacggaagtcgcttgtgtatgaacgcagcggcggacctgtgaggggatccgacttgccggcagaacttacgctgcgggaccccgggcactgttgctgctgcgggagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288735 - DNA, 823 bp, Homo sapiens
tgtctgagacaaatagaatggggcttgaacaaaagttagggaataggtgattttgtgtgtctggtttaattagcctcttaattatgtgaaaattgaccttggaggatacatagtaagagcggtattgctttctgtaaggttctttggtgagattgtgattacctataatgtgttctgtttcatcaggttctgcagctgattcatgagagagataacatctgtaaacagatccacctgccagcccagagtggaagcagccgtgtgttggaggccatgcggagggggtcaggcttgcttggagagggggcatccctcacttttccatgtttccttaatgaccaaacagtgtccttgttgccaagaacctagcatagtgtgtggcacaaagtagctgctcagtaaatatttattgtatgactaagccactgggcactggagtttgcttctgctcacttcataagcaaaggctaaggactggtcacccattttcactgtttagtttaaaaagcataaatatttactgagcagccactgtgtgacagtaagtatttattgtatgactaagccacagggcactggagcttgcttcgctaactccataacataggctaaggactgggtcatccattttcactgtttagtatgtttttttttaattaagcacctatggtgtggcacactctgagattttaattttttaatgttaacattaaggttttgttacatcttggaatttaaatgtcgctctatgtgttcactttctttgagaataataagtattacacagatgagactgaagggagaatctgtcccaaggcaagct

SEQ ID NO: 288736 - DNA, 856 bp, Homo sapiens
tgcctcctttgatctctctaggggagaaggctgagcagaccatctggaaccgtttacatcagcttaaagccttgaagacaaggcggccccgctcccgggttcctctgaggattggaattctaggtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacccgggcttcatagggtgaggatgtgtccgagaggaattagggttggggaccttatatttcggaaaaggaaagcattaacccggggtgccct

SEQ ID NO: 288737 - DNA, 2296 bp, Homo sapiens
  misc_feature (2102)..(2102): n is a, c, g, or t
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaaaaaaaanaaacaaaaacacaaaacaaacaaacacaaaaaaaaaaaacaacacaaacaaaaacaaaaaaaaaagaagacgagagagagacacaggagagcaacaagccgaaaaagaaaaataaataaaatacaacaaaaaaccaacaaaacacaaaaacaaaaaactaacacaaaaaaaaaacagaataaaccaataaacac

SEQ ID NO: 288738 - DNA, 1974 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288739 - DNA, 2041 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactatgtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288740 - DNA, 1645 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288741 - DNA, 1991 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288742 - DNA, 1667 bp, Homo sapiens
gaacggaagtcgcttgtgtatgaacgcagcggcggacctgtgaggggatccgacttgccggcagaacttacgctgcgggaccccgggcactgttgctgctgcgggaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288743 - DNA, 1199 bp, Homo sapiens
gaacggaagtcgcttgtgtatgaacgcagcggcggacctgtgaggggatccgacttgccggcagaacttacgctgcgggaccccgggcactgttgctgctgcgggaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288744 - DNA, 1632 bp, Homo sapiens
gaacggaagtcgcttgtgtatgaacgcagcggcggacctgtgaggggatccgacttgccggcagaacttacgctgcgggaccccgggcactgttgctgctgcgggagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288745 - DNA, 1531 bp, Homo sapiens
ttcctctcctcccacctccctatctcatgatggatgaacttcttggaaggcagagaaaagtctacctcgagacctatggctgccagatgtatgtgaatcagcacagagataagctggcacatctgaaggtagactgtagaggatcgcatcagtctcctcccagaggcagatctgattccactcctaacctgctacatcaggtgggaggctgcacaagggagaaggctgagcagaccatctggaaccgtttacatcagcttaaagccttgaagacaaggcggccccgctcccgggttcctctgaggattggaattctaggtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288746 - DNA, 2165 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaaggtgaggagtccttttgggcttttggcttgcactgtgaaatgagtgttggtttggatatttgtggtaataaagttttttcctagagacacattttagtaaaataaaaatcccctctcaaccagtacaatggaagggcactttggattggattttagactgctccttactaatgccttcttattcttcttacctattctcctgccctggaagcgttctttgtgggaatttggtgagtttggagtatgcagtggcatgtagtttctcgctgcagagaggccaggaggtggagtgatttcgagtgagtagagagtgttccctgttggagatcaacattttctttgtgatctctgacggc

SEQ ID NO: 288747 - DNA, 1954 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288748 - DNA, 1871 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggttctgcagctgattcatgagagagataacatctgtaaacagatccacctgccagcccagagtggaagcagccgtgtgttggaggccatgcggagggggtcaggcttgcttggagagggggcatccctcacttttccatgtttccttaatgaccaaacagtgtccttgttgccaagaacctagcatagtgtgtggcacaaagtagctgctcagtaaatatttattgtatgactaagccactgggcactggagtttgcttctgctcacttcataagcaaaggctaaggactggtcacccattttcactgtttagtttaaaaagcataaatatttactgagcagccactgtgtgacagtaagtatttattgtatgactaagccacagggcactggagcttgcttcgctaactccataacataggctaaggactgggtcatccattttcactgtttagtatgtttttttttaattaagcacctatggtgtggcacactctgagattttaattttttaatgttaacattaaggttttgttacatcttggaatttaaatgtcgctctatgtgttcactttctttgagaataataagtattacacagatgagactgaagggagaatctgtcccaaggcaagct

SEQ ID NO: 288749 - DNA, 1479 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgagtctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288750 - DNA, 1635 bp, Homo sapiens
gaacggaagtcgcttgtgtatgaacgcagcggcggacctgtgaggggatccgacttgccggcagaacttacgctgcgggaccccgggcactgttgctgctgcgggagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaagtctacctcgagacctatggctgccagatgaatgtgaatgacacagagatagcctggtccatcttacagaagagtggctacctgcggaccagtaacctccaagaggcagatgtgattctccttgtcacgtgctctatcagggagaaggctgagcagaccatctggaaccgtttacatcagcttaaagccttgaagacaaggcggccccgctcccgggttcctctgaggattggaattctaggctgcatggctgagaggttgaaggaggagattctcaacagagagaaaatggtagatattttggctggtcctgatgcctaccgggaccttccccggctgctggctgttgctgagtcgggccagcaagctgccaacgtgctgctctctctggacgagacctatgctgatgtcatgccagtccagacaagcgccagtgccacgtctgcctttgtgtcaatcatgcgaggctgtgacaacatgtgtagctactgcattgttcctttcacccggggcagggagaggagtcggcctattgcctccattctagaggaagtgaagaagctttctgagcaggggctgaaagaagtgacacttcttggtcagaatgttaatagttttcgggacaattcggaggtccagttcaacagtgcagtgcctaccaatctcagtcgtggctttaccaccaactataaaaccaagcaaggaggacttcgttttgctcatcttctggatcaggtctccagagtagatcctgaaatgaggatccgttttacctctccccaccccaaggattttcctgatgaggtgagcgtcaggttagctgtgacaaactgatattagtagtgtcttgagcaggccaaaggctggacccagtagggatgcagcagagacctggagtcctgcttagggatcctgtggggtattgctgcatcaccctccagatctgctggtcctttgaagatttgaagtccaccagtggctgggcacggggcttacaccaataatctcaacacttggagacgctgaggcaggtggattacttgagctcaggagttggaaaccagcctgggcaacatggcgaaaccccgtctctactgcaaatacaaaaaaattagctgggtggggtgggatacgactgtagttctggctacttgggagactgaggtggcatacgactgtagttccagctacttgggagactgagg

SEQ ID NO: 288751 - DNA, 1003 bp, Homo sapiens
gaacggaagtcgcttgtgtatgaacgcagcggcggacctgtgaggggatccgacttgccggcagaacttacgctgcgggaccccgggcactgttgctgctgcgggaggcagatgtgattctccttgtcacgtgctctatcaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288752 - DNA, 870 bp, Homo sapiens
gaacggaagtcgcttgtgtatgaacgcagcggcggacctgtgaggggatccgacttgccggcagaacttacgctgcgggaccccgggcactgttgctgctgcgggagatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288753 - DNA, 1047 bp, Homo sapiens
tgtctgagacaaatagaatggggcttgaacaaaagttagggaataggtgattttgtgtgtctggtttaattagcctcttaattatgtgaaaattgaccttggaggatacatagtaagagcggtattgctttctgtaaggttctttggtgagattgtgattacctataatgtgttctgtttcatcaggttctgcagctgattcatgagagagataacatctgtaaacagatccacctgccagcccagagtggaagcagccgtgtgttggaggccatgcggaggggatattcaagagaagcttatgtggagttagttcaccatattagagaatctattccaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288754 - DNA, 1036 bp, Homo sapiens
gaacggaagtcgcttgtgtatgaacgcagcggcggacctgtgaggggatccgacttgccggcagaacttacgctgcgggaccccgggcactgttgctgctgcgggagggagaaggctgagcagaccatctggaaccgtttacatcagcttaaagccttgaagacaaggcggccccgctcccgggttcctctgaggattggaattctaggtcaatcatgcgaggctgtgacaacatgtgtagctactgcattgttcctttcacccggggcagggagaggagtcggcctattgcctccattctagaggaagtgaagaagctttctgagcaggtgtgagcctcagcagcgatttcattgctggcttttgtggtgagacggaggaagatcacgtccagacagtctctttgctccgggaagttcagtacaacatgggcttcctctttgcctacagcatgagacagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288755 - DNA, 592 bp, Homo sapiens
aagccacggcgcgtgtgcgtggggggcaagcgccggcgtgatgacatcagtgtggacagcttggacttcaccaagaagatcctgcacacggcctggcacccggctgagaacatcattgccatcgccgccaccaacaacctgtacccagttggtgctagtggaagggctcagtaaacgctctgccactgacctgtgtggcaggaatgatggaaaccttaaggtgatcttccctgatgcagagatggaggatgtcaataaccctgggctcagggtcagagcccagcctggggactatgtgctggtgaagatcacctcagccagttctcagacacttaggggacatgttctctgcaggaccactctgagggactcttctgcatattgctgacctgagaggatggcctcagagctgacttgggcaatcctccccaacaggaaggggagacattgcctgccactgaggaaacaggtcatgaaggtggagataagctgcaaggggcgaagcaactttatgtcagtggaaaacgtgtctctttaaagctgctatgtgaacagcttttacagtcattaaatttacctaaactaaggttaa

SEQ ID NO: 288756 - DNA, 538 bp, Homo sapiens
tgtcttggacagtgaagggagctggcgttggtaatcacgctgcaactaggaatccctgacctcgccgaaccctcaactcactgccggctccgagtttcataaattgccgcggaacaacctcgtcgcactcttgcgcacgcgcaccagctgtggaaggaaccccctaggagcccccgcgacccggatcggtgaggtagaccaggcctttgccagccccgtccctttctgcaggccccgcccacgccgcacacttggaactctggccctgtgaatggactcacgtggcaatggatgcagcaatattcagtttccagaatcagcagctccggcagcagtgtcctgtgctgatggtgttggcagggagatggatacagggtatgtcagtatgattttcagaaatttagctccctactgtcacccgacaaccagaactctgaagacagtgaagattctatctccagatatggatccaactgttgctcaagatgtgggatctaactttattgctgtctgttacttaataaaatttacaaaagga

SEQ ID NO: 288757 - DNA, 426 bp, Homo sapiens
tgtcttggacagtgaagggagctggcgttggtaatcacgctgcaactaggaatccctgacctcgccgaaccctcaactcactgccggctccgagtttcataaattgccgcggaacaacctcgtcgcactcttgcgcacgcgcaccagctgtggaaggaaccccctaggagcccccgcgacccggatcggtgaggtagaccaggcctttgccagccccgtccctttctgcaggccccgcccacgccgcacacttggaactctggccctgtgaatggactcacggtgagcttctagtggcttaaagaaatgagcgtcatacttccggcgctgcctcatcccgtccggggaaactagtccaaatcgcctttctgttccccacaccccatttgtctggaatcaaaaaacaatgacaatttcgacaagaca

SEQ ID NO: 288758 - DNA, 1086 bp, Homo sapiens
agtcccgggagcccggcctcgtgcgccgcgctttgagcctctaggccatgaaactgcctcaccaagcactatgcaattgagtgcccaccagaagacacccctccagtcaacccacagaccccagaaagagtacccagaggagcctgagcacactccaccctatctgttctctgaaattcaatcaaatgagtcactctacttctctggaagcagaaagaggctggaagtttttctccaggtaagttcctccatgtagaaacatgaagaatagggataaggggcttcagcctggatggaatctcacactgaacctggcaaagctaggtgagggaagaggtttcaactggataagagtttgagttttgatatcttaatggactggactttttatgagtaaaataatccgctctttttaatgtctgaaagaaaagaaaaagctgtaaactacgtctgagaattgacacagttaagcttctaggggcagtcatgagaaaaaacactgttcctatctgcttacatactactgcatccagcttattcattaagccagatacagaaggctctgaggattttggcctcaacaactgggtatatggtggtggtcatttactaaaatagaggtgtcttttatttatttagtgacaggatctcagtctgtcacccaggtgggaatgcactgggtgacaaagtgagactccatctcaaaaaaataaataaataaaaataaaagtaaaaatagacaaaggaaaaacatgaaaatccgaacaaaaattctgcttgagtgctgggactttggtacctaagctgttagtcctcttccgatgttctttaattcaaccaacactgatcaagcatttgctctgtgcctggcaccgtttttaatgctgagagtacaacagtgaacaaaaacacaatccctgtccccacatagctgacatgccaggggagagaccaatgccacagaaaacaaacacatcaaacacacagaatggtgatttagtgcggcagatgggcagggagagcagggagcgctggtgggggccctgctgagggcggcagccaagcctcgcctggcctcagggaggt

SEQ ID NO: 288759 - DNA, 2543 bp, Homo sapiens
agtcccgggagcccggcctcgtgcgccgcgctttgagcctctaggccatgaaactgcctcaccaagcactatgcaattgagtgcccaccagaagacacccctccagtcaacccacagaccccagaaagagtacccagaggagcctgagcacactccaccctatctgttctctgaaattcaatcaaatgagtcactctacttctctggaagcagaaagaggctggaagtttttctccagcagcagactgctcgacaaacactgcgccaagagctcctcagcagaagctcctcgcatcagatcctctgtgctgggaatcctcccctcttgagcacactctgtgctcctcttccagttacggtgcatgtgaagcaatggtatgggaaaattgtttgcagaaggatgaaaaggctttattgccaaactcttaaggtattttgttaataaaatcattttcataatggaaaagactcagaaaattcccctcgcatgacatataacatccaacaaggggctgaaccaagaaaaaatactgcagctgctgctaatggcaacactgagcaagcacctggcctgtgccaggcactgtcctgtgcagtctgtgtttgcactcattttatcctcaagagccagatgagcatctccaccagacagcacctgcagaggcttgggcagtttattttaccgtctctgagtaaaatagggataataagtaacagtacccatacacaggtggcagagacgctagggaacttgcccaaggtcacagagcttccaagtggaggagcagggacacatatgctcacaatgatggcactaaggcacatgttgcctggatggagaccagcccacagatgagagttccaggacagagggaacatggatggatcaagtgaagtgacagaacatttggaaaactctaccgagatatatacggccccccagtaaaattaaagagataaagagaactacattaagtgagacaataaggcaactctacttcttgcaggaaaaaaataattgtggttatagaacactactggttctgaggtgaatagcagtcacagagccatcaaaatatgaccccactcactgaagtaatacaaagtgctagtgtagctatcccgggaagacgtggaaggccgagcaaggaccatggcacaagaggccacgctgtacctagtatggtatgcagtggccaagaggacccccctgattccacctagtgttcatgcccacgtgtgatctcctgccccgtgagctgggcctagccactcacttctgacagacagaagccaacaaaagcaacaggatgtcacttctaagtttaggttataaacacactcagacttccatctaggctcacctcttgctcactctgatgaaagccagctgccatgctgtcagctggggagaggcccatgtggcaggaactgaggaagtctttggccacagcctgcaaggaagtgaatcctgacacaagctcactagagtgagctgggaagtagatacccttcagtcaagctttcagatgaggccacaatcctagccaacattttcatttccacccatgagaaaccttgagccagaagacccaagctaagctacacctggattcctgacccacagataccatgataacagacattattttaagctgctatgttaggagtaattagttatttaggaataaggtaactaatacatttatattaatgggaagtcagcagagaacatttaaatggataaactgagaaatggctgtgtaagtgtgtgatctggaaacaggagaaaaatgcagccctgaagaaaggagttaagagaggaaggaggagctactatgtctcattttaaatcacgtgggtggcattatttgacttctttttaagtacacggaagtgttactttcttaaatgaaaatgaaggtaacagcagcagtaaactaatttccagtagatgaaatgtgactttgtaatcccaggaaaagggaagaatttgcaccaagaagttactgttacctcagaatggcaagagcatggatggctcttatcatcatctttatacttcttttacatttcctcattttttaaaagttttgtgtacatattacatttaggaaatccaatatatagtattaaaacagaaaaagtaaagaagcaggctgggcttggtgcccactactcaatttgactggcttaaaaaaataattttttaaacgacatgtacggacagacataatacttgcttctgagcctcccagtctttcaaaaccacattagggaataagcagtatttgcatggttccagtgatatctgggagtaagtgaaagtaatgaaaacacagaagtaaacacaaagtaattatagttcacctttatacacacgttaacagaaatcatctgatcccctttgctgctaagtgagttgaaaagcgaaagcgtctgaatcccaccagcatcgctggatgtgtcatccactgagccttcatctcccatgaacttgacttttaaccaatttgctagaattctacagatttaaaaaaaac

SEQ ID NO: 288760 - DNA, 819 bp, Homo sapiens
acctccctggttcaagcgattctcctgcctcagcctcccgagtagctgggactacaggtgcatgccaccatacctgggttaattttttgtgtttccagtagagacaagatttcaccacgttagccaggatggtctcgatttcctgacctcgtgatccgcccaccacggcctcccaaagtgctaggagattgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcacttccagtcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtgcacgtgcctgtagtcccagctactcaggaagctaaggcaggagaatcgctt

SEQ ID NO: 288761 - DNA, 788 bp, Homo sapiens
acctccctggttcaagcgattctcctgcctcagcctcccgagtagctgggactacaggtgcatgccaccatacctgggttaattttttgtgtttccagtagagacaagatttcaccacgttagccaggatggtctcgatttcctgacctcgtgatccgcccaccacggcctcccaaagtgctaggagattgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcacttccagtcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggcgggcggatcacgaggtcaggagatcgagaccatcctggctaagacggtgaaaccgtctctactaaaaatacaaaaaaattagccgggcgtggtggcggatgcctgtagtcc

SEQ ID NO: 288762 - DNA, 694 bp, Homo sapiens
tcccattgttgcagccctccagtagtcctatcagctttaatcaggctagaacacttcatcatgcaagtggtagcagataattaataatttctctgagtattaacttacatctcaaagtttttcttcccaggaaattacctttccacacagtctgagagtctggaagtcaagttggatgcgggagcatcgtgcccccctatagcatacagcagtccattccaggtcgtcactcctacgccacctctcctttttgacatctgtgcacacagtgtccacttattagtatgaggatcaaaacattctactgatttgagacaagaacttccatcacgaccaccaactgcataaagtctgcaaaaagaatatatgaaatgataaataagacatgtgccattatgcttagaacaaagaggctcttcttatgttgttatctcattgaatttaaggtgccatcagttataaaacacactgtcaatgtgtgtgtcattaaaaaagtatgctatgtttgaaatgacacatgtaagtatcatatatcactctgtatatacatgaaaaggaaaacaaactgcacatgaaggcagtgacaactgtttcatcactgccatctctttgacaagtcaccattggttgtaatatgcatggaaattcagaggtgttaaaatatgtcttagaatagacaaaatatggtgtataa

SEQ ID NO: 288763 - DNA, 1195 bp, Homo sapiens
tttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggatgtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacaggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatg

SEQ ID NO: 288764 - DNA, 1572 bp, Homo sapiens
gatcccggtgccagggaccctgcccagttccaggcgtcgccctgacccagaaacgactgggcgccgccgtcctggaaaggccccagcgcacggacatctgaggagctgtttccgttcctctgcccgccatgccgttcctggagctggacacgaatttgcccgccaaccgagtgcccgcggggctgagagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggttccctacggtcttatccaccagccctgctgcccatggtggccccagatgcccaggagagataatagaaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggatgtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacaggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatg

SEQ ID NO: 288765 - DNA, 667 bp, Homo sapiens
gatcccggtgccagggaccctgcccagttccaggcgtcgccctgacccagaaacgactgggcgccgccgtcctggaaaggccccagcgcacggacatctgaggagctgtttccgttcctctgcccgccatgccgttcctggagctggacacgaatttgcccgccaaccgagtgcccgcggggctgagagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttctatgattgggcacggagggatccagggcatctgtgaactaggctgcttcttccagagagatctcttggcagagtgagggcctggagataaccagctattggattatcccgcatgcaacattcctgtgatcacataatcctcttcttcatcctcatatgaaataacatgaaggagagcttcctcatt

SEQ ID NO: 288766 - DNA, 626 bp, Homo sapiens
gatcccggtgccagggaccctgcccagttccaggcgtcgccctgacccagaaacgactgggcgccgccgtcctggaaaggccccagcgcacggacatctgaggagctgtttccgttcctctgcccgccatgccgttcctggagctggacacgaatttgcccgccaaccgagtgcccgcggggctgagagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtg

SEQ ID NO: 288767 - DNA, 551 bp, Homo sapiens
  misc_feature (37)..(37): n is a, c, g, or t
  misc_feature (51)..(51): n is a, c, g, or t
gggagtgcccgtctggcccgaggtttggttttaaaangacgactcgggttnacaaacgcgcttctggcaaaaccgaccaagagtgatgtctctctgtgagtttaaagctggccaggagcaggtaaaataaagcattctgagtggatgtgcactgcatggagttggctgtcagctggcaggggtgatgcacatggaggaggtggggagcctgttcagaccctcggaccctgtacctgttcgctcatggtgttgatcccatcgggccccagcagagacactgcctgcttcaccaggtctgttcgtccacagttcagcatccggaaacccaggtcctgcttaaacttggcttcgatggccaccgcatccagctttcgagatgcacaaaagcagtcgtcggccctaaggaagggaagagacatcatgcgggtacagcggcttcccagaggggcacaggagcaaactccgcaggaagcaccctgggacattgcatttgcttttcatgtaaattgcctgttcctaggctccaattaaaatgatggcctccggatgtc

SEQ ID NO: 288768 - DNA, 332 bp, Homo sapiens
caactgtctcttggaccgttcggatacagatgggaatgtatcccagtcctctgccattgacctcaggaaacgctgcagccagctggaaggacattcaggtacccgggtaggctcctccctgcgacagaccttcagcttcctctcgggcatgaccggaaaggccaagacccgggaaaaggaggagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccact

SEQ ID NO: 288769 - DNA, 603 bp, Homo sapiens
agtgacccacccacctcggcctctcaaagtgctcagattacaagcgtgagccaccgcacctggcctggaaacatctattttctaagaaaccgtatgatacaggacaccactggactaagagttagatagctggttctaatactcgttctgttactaacaagttttgtgaattttagatacctctcatcttttgatacttcattaatctgtatcattaagagctcacattggattatctctgacgttcctgccagttctaaaattccattattggccaggtaatcccaatactttgggaggctgaggtgggaggatcctttgagccaaggactttgagactagcctaagcaacacagagagatccctgtgtctacaaaaaaaataattttttaaattagctgggaatggtggcctgtgcctgcagtcctagctacccaggaggctgaggcgagaggattgctagagcccaagaattcaaggctcttcaagcacggagctatcagtgcaccactgcattccaccctgggtgacagaatgagacgctgtctctaaaaaataaaaaataaaaataaaatcccaccatttcactacacatactataat

SEQ ID NO: 288770 - DNA, 683 bp, Homo sapiens
taaaaaacaaaaatggattgccaacctcccctaccatagagtgtctaactcagaagcatgaactggcgtggcatatgcctgttgcctatgtatagtttctcagtataaagcttttctgaattgtcagattctgtggacatttggaggctaggaggtaagattccaaaaccagcatgtcaaccaaagccaataataaggcctctcaaatacctaccacatatctgaagagaaacttttaacagttttcactatatatttaaaacaaaaagtcagaagagtaaaaaagtcccattttaaactgtatatataccatcttaattcttgtgttggactatagtaaataacaaattcaggccaggtaatcccaatactttgggaggctgaggtgggaggatcctttgagccaaggactttgagactagcctaagcaacacagagagatccctgtgtctacaaaaaaaataattttttaaattagctgggaatggtggcctgtgcctgcagtcctagctacccaggaggctgaggcgagaggattgctagagcccaagaattcaaggctcttcaagcacggagctatcagtgcaccactgcattccaccctgggtgacagaatgagacgctgtctctaaaaaataaaaaataaaaataaaatcccaccatttcactacacatactataat

SEQ ID NO: 288771 - DNA, 454 bp, Homo sapiens
taaaaaacaaaaatggattgccaacctcccctaccatagagtgtctaactcagaagcatgaactggcgtggcatatgcctgttgcctatgtatagtttctcagtataaagcttttctgaattgtcagattctgtggacatttggaggctaggaggtaagattccaaaaccagcatgtcaaccaaagccaataataaggcctctcaaatacctaccacatatctgaagagaaacttttaacagttttcactatatatttaaaacaaaaagtcagaagagtaaaaaagtcccattttaaactgtatatataccatcttaattcttgtgttggactatagtaaataacaaattcaggccaggtgcagtggctcacgcctgtaatcccagcactttgggaggccgaggcgggcagatcacgaggtcaggagatcaagaccatcctggcgaacacggtg

SEQ ID NO: 288772 - DNA, 405 bp, Homo sapiens
cggtgcggaggctgcgggccccgggcaggcgcgaggaggcggcgaaggcgcagggaaggggcccggcccgcgggaaggaaccgcagcgacagccgccaggagcccgggacggagccggggacggagcagcaggaaccagaccggtcacttccaaaggcccctcagaacgaccaacagctgaaacccgcggggcggactccgtgttgaaccgcggacagcggcaaccacagcagcgacacggacctgtgcttccaccaagaacagattccgcagcggacagcagtcacttgcagtggtagtatttatcccacacaaacacccagctaatgccttcacccggtccaggaactctgtagtgttctaaagtaaaatcaataaaacatacatttgtgtttcatcaacaga

SEQ ID NO: 288773 - DNA, 513 bp, Homo sapiens
gcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaagg

SEQ ID NO: 288774 - DNA, 523 bp, Homo sapiens
gcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggtgagctctccggagtgcgctgccaaggccgggtcctttcatctccatcgacaccagcgtgccttgtcacagatactggggttggaagcagatgccctctgcctgtgtctttatcatgcatttgcagcgtgttgtcgcgtaacccgttggcggctgcaggaa

SEQ ID NO: 288775 - DNA, 441 bp, Homo sapiens
accatcacggacacgtcgatggccctcaggaagctgtgatgcaccttgatcaggtcctccaggttaatgaagacagctgccatgtccgccgggctcagcactagccgcagggggctcatgtagttcttctcaatgtcctccagggtgcggtagtacttggcctcggtctcctggatctccacgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaagg

SEQ ID NO: 288776 - DNA, 2263 bp, Homo sapiens
acaggcgggcactctctgcgggtcccgcggctcccgcggcttccggcccactcagcgcctccagaggcctcaggtgagggtcaccccccgcagcttggggtcactcccctgagcccccggatcttcccatgggtcctttggaggcctgggttttggagtttgtccttcgttaagtgccgcccgccgggcgcggctgctccaggaccacagacgagtctcgctctgttgcccaggatggagtgcagtggcgcgatctcggctcgctgcaagctccgcctcagcctccggagtagctgggactacaggagcccgccaccacgcccagctaatttttttgtatttttagtagagacggggtttcaccgtgttagccaggatggtctcgatctcctgaccttgtgatccgcctgcctcggcctcccaaagtgctgggattacaggcatttcgctggggatgctacttgatctctcttcagcctcagtttcctcacctggacagtggagctgaacccaccccccactatctgaccctgctctctgggctgtcttttgggaacccgccctgctgaggcctgctccccaccctccatggctgtcagccccccaggagaagaatgtctgccatatggaggctgctggcagcaaagggagatgaacaagccaaggttgcccggcctgcatgccggcccagggctgctgctgtgtcttgccatcaaccctcccctgacacccaggatgcctgcctcacccagaagcactcctacgtcaggcctctgagggggagcgcttcatgccactgttatcaaaagaagaaaccatcgaagcagaaaggccaatgccacactagacagccaggagcccagcagaacaagtggccccctaaggcactttggggaccacaccccgccactgaccccagcacagtctggttcccagggcttcaggatcctcctggggacctctcagcatgattgacacaggcagacgggacctgaaggggctgctggtccttctgaaaatgttcaccaggtagtgtgagtgtggggaagccatgaacaatgtgtgggactctaccctgcacctgctcagagcctcagcccttcagagccactactaatgatttgctgtgggtggggtcaccctgatacttctctgaggtggctttttcttgcagtttttctgagtaactgacaggaatccttgactgcatgccgcctaaactagggtgtgcacagccctcgttctgtgcaaagagggtgcaaagcagcagagtgtctgtgacccatttgccacctaatgttactacaagatttgcaagaaccggtcacttatcagtaaccatttttatttaaaaagataaaatagagctttgcaggaaagtgctgcaggctcccacgttgccgggcagacgacaacctgggcgcctcgcccagctcctccccacagccattggcatccactgtcaggtttcaatgttcttggacctcagggccttcgtcctctccaatctaaatgcagagagacatttgacatggactctctcaggtgttttgcaaaatgcaacacattctcattgactctggtcactctgctgtgcactacatgtcaaaacctcttcctcctccctgagactttggtcctttaactgacaacccccctcccattccctccctctgccactctctgacccctggtcaccatcgatctacttgctacttctatggggtcaacttgtttagatcaacacttctgggacctcacgtggaattggtctctctgaggtagtggagatgctaagtagtgggatttcctcattccacattgtaccccatgaatgaatacaagcatgatttgccaattgaagcaatacaataaagacagaagaaatgtaaaatgcaggaattgtggcttgaccaccacaacgacttgatttttgtcttcagccatgcaactatgttggggcgatcttattcctccttttctttggtagagacaggcaaaaatattttaatagtatgcaaaggcatctatctcctggcaaccctgcggcagccccagcttcttgccgagcaggctgacgtcacagcctcaggcttctcagcttggacttctcagcttggacgatgctggcttcctgggatggtttttggtgtatcagggacgtttctaagacttcaccagttgctggtgctctgggtgaaaggggagacaatagggtcatgctgggggcttcactaaaacttcctggcttccccgatctggc

SEQ ID NO: 288777 - DNA, 1951 bp, Homo sapiens
gaggtagagccagagacccgtaagcggagccgaacccctatgagcttgcccagtagggagctcaggatccccaagattggacaggcaaataagcttagtgatagtcccaccagtcttcccgagagtcacgatttcgctggggatgctacttgatctctcttcagcctcagtttcctcacctggacagtggagctgaacccaccccccactatctgaccctgctctctgggctgtcttttgggaacccgccctgctgaggcctgctccccaccctccatggctgtcagccccccaggagaagaatgtctgccatatggaggctgctggcagcaaagggagatgaacaagccaaggttgcccggcctgcatgccggcccagggctgctgctgtgtcttgccatcaaccctcccctgacacccaggatgcctgcctcacccagaagcactcctacgtcaggcctctgagggggagcgcttcatgccactgttatcaaaagaagaaaccatcgaagcagaaaggccaatgccacactagacagccaggagcccagcagaacaagtggccccctaaggcactttggggaccacaccccgccactgaccccagcacagtctggttcccagggcttcaggatcctcctggggacctctcagcatgattgacacaggcagacgggacctgaaggggctgctggtccttctgaaaatgttcaccaggtagtgtgagtgtggggaagccatgaacaatgtgtgggactctaccctgcacctgctcagagcctcagcccttcagagccactactaatgatttgctgtgggtggggtcaccctgatacttctctgaggtggctttttcttgcagtttttctgagtaactgacaggaatccttgactgcatgccgcctaaactagggtgtgcacagccctcgttctgtgcaaagagggtgcaaagcagcagagtgtctgtgacccatttgccacctaatgttactacaagatttgcaagaaccggtcacttatcagtaaccatttttatttaaaaagataaaatagagctttgcaggaaagtgctgcaggctcccacgttgccgggcagacgacaacctgggcgcctcgcccagctcctccccacagccattggcatccactgtcaggtttcaatgttcttggacctcagggccttcgtcctctccaatctaaatgcagagagacatttgacatggactctctcaggtgttttgcaaaatgcaacacattctcattgactctggtcactctgctgtgcactacatgtcaaaacctcttcctcctccctgagactttggtcctttaactgacaacccccctcccattccctccctctgccactctctgacccctggtcaccatcgatctacttgctacttctatggggtcaacttgtttagatcaacacttctgggacctcacgtggaattggtctctctgaggtagtggagatgctaagtagtgggatttcctcattccacattgtaccccatgaatgaatacaagcatgatttgccaattgaagcaatacaataaagacagaagaaatgtaaaatgcaggaattgtggcttgaccaccacaacgacttgatttttgtcttcagccatgcaactatgttggggcgatcttattcctccttttctttggtagagacaggcaaaaatattttaatagtatgcaaaggcatctatctcctggcaaccctgcggcagccccagcttcttgccgagcaggctgacgtcacagcctcaggcttctcagcttggacttctcagcttggacgatgctggcttcctgggatggtttttggtgtatcagggacgtttctaagacttcaccagttgctggtgctctgggtgaaaggggagacaatagggtcatgctgggggcttcactaaaacttcctggcttccccgatctggc

SEQ ID NO: 288778 - DNA, 1917 bp, Homo sapiens
caccctctcctgagcctgcttcttgcttcctggtcctgttctttattggggaaggagaatcttatctgactgggggaactccaggactgaccctggccaccatcagtagtgggtagggtaaccaaatgttcaaggttgccacactcagatgccggccatgcacaagggtggggccttctggacctacctcaagctcattaggaacccacaaggaagctccttgatgggtgctgatgggcatctgcacccacagattcactgccagacaaggacaaaccgggttcctgggaagctggaacctaccttatgaaagcccccattcccaccaccccctccatccctcagggctgctgctgtgtcttgccatcaaccctcccctgacacccaggatgcctgcctcacccagaagcactcctacgtcaggcctctgagggggagcgcttcatgccactgttatcaaaagaagaaaccatcgaagcagaaaggccaatgccacactagacagccaggagcccagcagaacaagtggccccctaaggcactttggggaccacaccccgccactgaccccagcacagtctggttcccagggcttcaggatcctcctggggacctctcagcatgattgacacaggcagacgggacctgaaggggctgctggtccttctgaaaatgttcaccaggtagtgtgagtgtggggaagccatgaacaatgtgtgggactctaccctgcacctgctcagagcctcagcccttcagagccactactaatgatttgctgtgggtggggtcaccctgatacttctctgaggtggctttttcttgcagtttttctgagtaactgacaggaatccttgactgcatgccgcctaaactagggtgtgcacagccctcgttctgtgcaaagagggtgcaaagcagcagagtgtctgtgacccatttgccacctaatgttactacaagatttgcaagaaccggtcacttatcagtaaccatttttatttaaaaagataaaatagagctttgcaggaaagtgctgcaggctcccacgttgccgggcagacgacaacctgggcgcctcgcccagctcctccccacagccattggcatccactgtcaggtttcaatgttcttggacctcagggccttcgtcctctccaatctaaatgcagagagacatttgacatggactctctcaggtgttttgcaaaatgcaacacattctcattgactctggtcactctgctgtgcactacatgtcaaaacctcttcctcctccctgagactttggtcctttaactgacaacccccctcccattccctccctctgccactctctgacccctggtcaccatcgatctacttgctacttctatggggtcaacttgtttagatcaacacttctgggacctcacgtggaattggtctctctgaggtagtggagatgctaagtagtgggatttcctcattccacattgtaccccatgaatgaatacaagcatgatttgccaattgaagcaatacaataaagacagaagaaatgtaaaatgcaggaattgtggcttgaccaccacaacgacttgatttttgtcttcagccatgcaactatgttggggcgatcttattcctccttttctttggtagagacaggcaaaaatattttaatagtatgcaaaggcatctatctcctggcaaccctgcggcagccccagcttcttgccgagcaggctgacgtcacagcctcaggcttctcagcttggacttctcagcttggacgatgctggcttcctgggatggtttttggtgtatcagggacgtttctaagacttcaccagttgctggtgctctgggtgaaaggggagacaatagggtcatgctgggggcttcactaaaacttcctggcttccccgatctggc

SEQ ID NO: 288779 - DNA, 2490 bp, Homo sapiens
  misc_feature (339)..(339): n is a, c, g, or t
aaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgntctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggtgagtgggagggaggtacagggaagcgtggggcaggtatgcccagaaaggtggcctgtggcagctctttgtcccttagccactgtgctcctgacatggcatcattccttccctgcaggttggagcctcccctcatacctctctgtggttgtggcgctgggaaacctgggtctgctggtggtgaccctgtggaggcggctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatacat

SEQ ID NO: 288780 - DNA, 2372 bp, Homo sapiens
  misc_feature (339)..(339): n is a, c, g, or t
aaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgntctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcggctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatacat

SEQ ID NO: 288781 - DNA, 2406 bp, Homo sapiens
  misc_feature (339)..(339): n is a, c, g, or t
aaaagcgctagggttgcaagtggcaccagagacgtgcccttgtcccggggtccatttgagggtgagcgtgttggtgccgagctgtttttttgttttgttttgttttgttttgtttttgagaccgaatctcgttctgtcgcccaggctggaatgcagtggtgtgatcttggctcactgcaacctccaccttccgggttcaagtgaatctcctgcctcagcctcctgagtagctgggattactggcacccaccaccacgaccagctaatttttgtatttttagtagagacgggttttcaccatgttggccaggatggtctcaatctcctgacctcaggcgntctgccttcctcagcttcccaaagtgctgggattacaggtgtgagccaccgcacccggccagtgctgagctgttttgacaacttggaccccgggtcctctgtgggtaggaaaatcagctccctctttgctcctctggggcagctgcacctcgggccagctttctgcctgtctgcctgccggcactgctgggtcgctgtacccaaacgcacagccggtgccccgtgcctattacctgccagcctgtctgtttccctccagctagaaggtcttcagtttccagaagaaccaaagcatctttggacctacctagggaaggacctgcctgtgacctttgccctgtcctggagggtccagctttgggctgaatggcagcacccacgctgggccgtctggtgctgacccacctgctggtggccctttttggcatgggctcctgggctgctgtgaacgggatctgggtggagctgcctgtggtggtaaaagaccttccagagggttggagcctcccctcatacctctctgtggttgtggcgctgggaaacctgggtctgctggtggtgaccctgtggaggcggctggccccgggcaagggcgagcaggtccccatccaggtggtacaggtgctgagtgtagtgggcacagccctgctggcccctctgtggcaccacgtggccccagtggcagggcagctccactctgtggccttcctaactctggccttggtgttggcaatggcctgttgtacctctaatgtcactttcctgcccttcctgagccacctgccacctcctttcttacggtctttcttcctgggtcagggtctcagtgccctactcccctgtgtgctggccctagtgcaaggtgtgggccgcctcgagtgcccaccagcgcccaccaatggcacctctgggcctcccctcgacttccctgagcgttttcctgccagcaccttcttctgggcactgactgcccttctggtcacttcagctgccgccttccggggtctcctgttgctgttgccatcactaccctctgtaaccacagggggctcagggcctgaacttcaactgggatccccaggagcagaggaggaagagaaggaggaagaagaggctttgccattgcaggagccaccgagccaggcagcaggcaccatccctggcccagaccctgaggcccatcagctgttctcagcccatggtgccttcctgctgggcctgatggccttcaccagtgccgtgaccaatggcgtgctgccttctgtgcagagcttttcctgtttgccctatgggcgcctggcctaccacctggctgtggtgctgggcagtgccgccaacccccttgcctgcttcctggccatgggcgtgctgtgcaggtccctggcagggctggttggtctttctctgctgggcatgctctttggggcctacctgatggcactggcaatcctgagcccctgcccacccctggtgggcaccactgcaggggtggtccttgtggtgctgtcgtgggtgctgtgtctgtgtgtgttctcatatgtgaaggtggctgcaagctccctgctgcatggtgggggtcggccggcattgctggcagctggtgtggccatccaagtgggctccctgcttggtgccggtgccatgttccctcccaccagcatctaccacgtgtttcaaagcagaaaggactgtgtagacccctgtggcccctgagcctgggcaggtggggacccaactccaccccacctgtcttcatcgtgaggctgccacagtgcctgactacttgtggcccaggcaggcttcccccaacacaggaacgctcatggacacctgcacactccacagaagacgttggcatgtgaggccagggtgggcaccaaagaccaggcccagagccaggggacaggttggggctgtgggcttggacccagggcctgagacctttgtgggatttgtgcaataaagtgtttttatttaaaaccaaaaacaaaaacaaaagcctaatgaaaaccttataagaaatatataatgaaatcaggaaactggattaaataatttttcatacat

SEQ ID NO: 288782 - DNA, 435 bp, Homo sapiens
tccggccgcccccgcccgctcgggtcccgccgcccctccggccccgctgggctcccaggccgcggcagcacgggcgggacacggaccgagggaccagccggcggaaagtttcctccgagatcaaataaacggagtcttggagagattgaattgactttaccaaaaccgtcaggatttgaatctgctgctctctgatcctaaagcctgagctagaaaccaccgctccccctcctaggaggccccttccaggcaaagctgcttctcttccccagacccatgctggactggaagggaggggactgtccacccctccttccagggcccaggcttgaatgtgtcccctggccgagctctggtctagtcacgcagggttaatgattgttggactccagctttgagccagggcccggccagcagtctcgcagaccccagcgt

SEQ ID NO: 288783 - DNA, 401 bp, Homo sapiens
gcgtccgactggagctcagccgcgcttgtccggtgctaggtcatcctgccaaacacccgaggccccaaagatggtgcaaagtgaacttcagctacagcccagagcaggcggacgagctgaagctgcaagctggggagatcgtggaaatgataaaggaggccttggtaacccagacatgccttcagtcagcccgggtccccagcggcctcccaagaccacagaggataagggctggtgggaaggagagtgtcaaggacgaagaggagtttttccagacaactttgtactcccaccacccccaattaaggatgctcaacctttacttcttttcggcatagatcaagaagctggtcccacggaaagtggtatctcgggaatcaggtgagtgcccggggagcctg

SEQ ID NO: 288784 - DNA, 1922 bp, Homo sapiens
gggcgtatctgagtgactagagcccaacagcccgtcgttcacggctccaactgggagctggctatggacacctccagaatactgcagaagctccaccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagc

SEQ ID NO: 288785 - DNA, 2783 bp, Homo sapiens
ggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggagatgaggacggctggtggctggggaagaagaacgggcagctgggagccttcccatccaactttgtggaattgctggacagtgggcccccaagccttggtaacccagacatgccttcagtcagcccgggtccccagcggcctcccaagctgagcagcctggcctatgacagccctccagactacctgcagacagccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagcacggcgccacgccggtctggtcgctgggggcggggcctgcgcgggggcagggcctgggcctccgcattcctgacggtccctcccaggcacatctggccaacatgtggctcccattaccgttcccaaggcctgcgcgcggctatttttatccaccggatggtgaggggcgggggagggtgtctccttcggactccagccgcgcactggagaaatggcgggcaggaggggcccaggcggggtcgggctcttgacgcccggcctagattccggaatccagctgtgcgccggggaggagccgggcgggccttctcgccagctcggacccctcccagctggcctccctgtccgctcagagggactcctgccctctcgcttgaacgcacctcggcgcaga

SEQ ID NO: 288786 - DNA, 1835 bp, Homo sapiens
ggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggagatgaggacggctggtggctggggaagaagaacgggcagctgggagccttcccatccaactttgtggaattgctggacagtgggcccccaagccttggtaacccagacatgccttcagtcagcccgggtccccagcggcctcccaagctgagcagcctggcctatgacagccctccagactacctgcagacagccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcgccactaacagcaacaacagagaggctggagctctgcctgcgtgcggcccaagggctaaaccttggacaggttctttcacttactccgcctgacaaccctgcgacgtgataccattatccccacttcgcagatcaaataaacggagtcttggagagattgaggtgaatttggctaacctgtaaaaaataaaaaaaaa

SEQ ID NO: 288787 - DNA, 617 bp, Homo sapiens
ggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggaggccttggtaacccagacatgccttcagtcagcccgggtccccagcggcctcccaagctgagcagcctggcctatgacagccctccagactacctgcagacagaccacagaggataagggctggtgggaaggagagtgtcaaggacgaagaggagtttttccagacaactttgtactcccaccacccccacagttccagcgacactcctgcctcagcctccctgtgcctctggagatcctctagatca

SEQ ID NO: 288788 - DNA, 233 bp, Homo sapiens
atgaggacggctggtggctggggaagaagaacgggcagctgggagccttcccatccaactttgtggaattgctggacagtgggcccccaagtgagacctcgactctgtgaccctgtgactcgcaatctccaatgaccctcccagtggcatgagcctgtgattcacatatcctgaccctgtgacccctctgaccctctcccatgacctaacctgtgaattagcaccctccctaa

SEQ ID NO: 288789 - DNA, 2389 bp, Homo sapiens
ggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggagatgaggacggctggtggctggggaagaagaacgggcagctgggagccttcccatccaactttgtggaattgctggacagtgggcccccaagccttggtaacccagacatgccttcagtcagcccgggtccccagcggcctcccaagctgagcagcctggcctatgacagccctccagactacctgcagacagccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagc

SEQ ID NO: 288790 - DNA, 1435 bp, Homo sapiens
tgtgcacgggtgaagtctcccaggccaaggggaaccagactcaacctcagctgagacttcacctcccatcacggcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagcctccttcctcagagaggtgcctgggagagatgaaatgtaccctagttagaggggacagctccccacgccaggctgagttgaagtctgggccagcatccaggcctgcccttgagaagccccacccccacgaagaggctacaacccttccagaggaggcaccttccaatgacgagaggacccctgaagaggaggcgccccccaacgagcagaggcctctgagagaggaggtgctccccaaagagggagtggcttccaaagaggaggtgaccctgaaagaggaattgccccctaaagaggaagtggctccaaaagaggaggtgccccccatagaaagagcctttgcccaaaaaacacgtcctatcaagccgcctccagactcccaagagacgctcgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggagcagcgccggcggctggaggtccaggtgatgcaggggacccagaagtcccagaccccgcgcgtcatccacacgcagacgcagacctactgagggtgggcctgggaagggaccgcggcctgacctggctggggccacccacgtccttgcacacgactttgggaaacgcgagaaagtaaactctgcctagc

SEQ ID NO: 288791 - DNA, 1755 bp, Homo sapiens
ggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgagcgcctggtgcaggagatcccagagaccctgcggggctccggagaggcgcggaggccgcgctgtgcgcgccgccgaggtcatcctgccaaacacccgaggccccaaagatggtgcaaagtgaacttcagctacagcccagagcaggcggacgagctgaagctgcaagctggggagatcgtggaaatgataaaggagatgaggacggctggtggctggggaagaagaacgggcagctgggagccttcccatccaactttgtggaattgctggacagtgggcccccaagccttggtaacccagacatgccttcagtcagcccgggtccccagcggcctcccaagctgagcagcctggcctatgacagccctccagactacctgcagacagccaccctgaggtctacagggtcctgtttgactaccagcctgaggccccagacgagttggcgctgcggaggggggacgtggtaaaagtactcagcaagaccacagaggataagggctggtgggaaggagagtgtcaaggacgaagaggagtttttccagacaactttgtactcccaccacccccaatcaagaagctggtcccacggaaagtggtatctcgggaatcagctcctattaaggaaccaaaaaagttgatgcccaaaacatccctccccacagtcaagaagctagcaacagccaccactgggcccagcaaagccaagacatctcggacacccagcagggacagtcagaagctcacctcccgagactcaggccccaatggtggcttccaaagtgggggttcgtatcaccctggccgaaagcgatccaaaacccagactccccagcaacgctctgtgtccagtcaggaggaagagcacagcagcccggtaaaggccccctctgtgaagagaacccccatgccggacaagactgccaccccagagaggcccccagctccagagaacgcccccagctccaagaagatcccggctcctgacaaagtcccctccccagagaagaccctcactctaggggacaaggcctctatcccagggaactccacctcggggaagatcccagctcctgacaaagtccccaccccagagaagatggtgactccggaggacaaggcttctatcccagagaactccatcatcccagaggagaccctgactgtggacaaaccctccactccagagagggtcttttcagtggaagagtcccctgccctagaagccccacctatggataaagtccctaatccaaagatggcccctctgggggatgaggcccccactctagaaaaggtcttgaccccagagctttctgaagaagaggtgtccaccagagatgacattcaattccatcacttctcttcggaggaagccctgcagaaggtcaagtactttgtagccaaagaggatccatcatcccaggaggaggcccacacgccagaggcacccccaccccagccatcttctctggggtggggactttgtcaggagctgggatcttcccgagtggagttcctggatgagcttgtccccacagagagagcgtcgggatcctctagatcacctcagcacacta

SEQ ID NO: 288792 - DNA, 428 bp, Homo sapiens
ctccagtgcggggaggactggaggacagggatggggtggctgtgcggagggacagaggtgggaagagactgagggtcagagtaggcttgggtccctgaggttctgctctcttaggccccaatggtggcttccaaagtgggggttcgtatcaccctggccgaaagcgatccaaaacccagactccccagcaacgctctgtgtccagtcaggtgaggggcgggagacatgggagagtggggatgctgggcagaggctggttcccagctgtggtgtgcacgggtgaagtctcccaggccaaggggaaccagactcaacctcagctgagacttcacctcccatcacggcaggaggaagagcacagcagcccggtaaaggccccctctgtgaagagaacccccatgccggacaagactgccaccccagagagg

SEQ ID NO: 288793 - DNA, 762 bp, Homo sapiens
ggagggcaacacagatgtcccaggggctggaagcctcaggctgctctgggcttatgtggctcagctgggggctcggcttgtcctggagggggcagccctggggttgcagtaccacctgtatgggttccagatgcccagctcctttgcatgtcgccgagaaccttgccttggtagtataacctgcaatctgtcccgcccctctgagaagaccattttcctaaagaccatgtttggagtcagcggtttctgtctcttgtttacttttttggagcttgtgcttctgggtttggggagatggtggaggacctggaagcacaaatcttcctcttctaaatacttcctaacttcagagagcaccagaagacacaagaaagcaaccgatagcctcccagtggtggaaaccaaagagcaatttcaagaagcagttccaggaagaagcttagcccaggaaaaacaaagaccagttggacccagagatgcctgagttggagatgaactttggccaactttcctcatcaccatacttaaaatcctgtccaaggaggagcttattcaccattttctatacatgtgacatatgtagcagcataaccgacaactgggactgcgctgccttgactccacctctacatacaatgactcagctaaccagactaataaaagccatgtttgcaccattgctcagggaggcattgctttggggaattattcccagtgtcctccttacttatcgcaagtaataaaatccccctgggaaatcct

SEQ ID NO: 288794 - DNA, 811 bp, Homo sapiens
agccctagtgttgaagaacatgttacaccagcacacgccgccgtcgccagcagcaggaagttgttgatttgcagcatattcacactttctgatgcagtcagagctcactgcttctcagaacagatccactcagaaggaactccagtttctgatgtttattttactttttcttccccccaaacaaggcacaaaaggggaaaatgaaagggacacaagaaaaaagaatcaagggtcttactgaccccatcacacacctcctctaatgtcatggctggaaggaaataagaagcccttcctcgggagaatgccagaggcccttgattgaagtcaaggacataagggatgacctcctcccagtccccagccctcaccttcgccttgcgtttgctgtcatccatgatcatcttccagtccgagccgttgttgctgtacccgatcttgaacttcctcatgaacaccttgttctctcggtgcttcccaccctgaatgatgatgcccctcacgatcttctcctcccccaggtctatttggagccactcattgatgtaggaatgaggtgcgggtggaagtgcccagccagagcgactggttaccaggcggatgttttcaggcatccagtttctgtccccttggttggatgatgtgatctgggagtcagaaataagtccagacaccatacccaacattccagagcaaggataatctgggaagtgaaatgaaacagataatgtaaaatgatttcctgggcgactccatgctaagaaataaaatacaacatatggaataaagacatgattttgtacccaatcat

SEQ ID NO: 288795 - DNA, 1041 bp, Homo sapiens
agccctagtgttgaagaacatgttacaccagcacacgccgccgtcgccagcagcaggaagttgttgatttgcagcatattcacactttctgatgcagtcagagctcactgcttctcagaacagatccactcagaaggaactccagtttctgatgtttattttactttttcttccccccaaacaaggcacaaaaggggaaaatgaaagggacacaagaaaaaaggtagctgcacagagagataaatataacactgaaaatattttagaaaccacaagttaaggaagggagagatgggagagagattcagatatttctgatggcacccagccctgccagtggcccgctgctctagtggtagccggtggcctgtcggggacacggaggtttccttggagccttcacatctggagggagtgggagctggcagcacagcctggcttctttgctgcctgcaatgcctctggcttgagtcactatattaagccatgttcccacacttgcttagagtgggagtgagggtaatattcccttcaataagctaaaatctgtttttcacaagaggagtaggtcctggccaaagcagggatggaaaggctaagaccaaaaggccaattgtattggtgtgagaaataccatcgctgaatataattcccacactgaacacagaacttaaactgctagttgtctgtaggttggtccatatttgaatcctaaaccagcttctgggccacccagcacactccagggtatcctttccaagttgctgttgcatgttcgcaaataaatttagccatcactctaagtaaggtggatgttggaatggaatgtttttgtgttgagatttccttttcttttcactggattatcaagagcctactgcatcttaaaaggtttcaacgcataaagaaatatacttaagcattattcacaatagctaaaggtgacagcaattcaagtgtccatcagtggctgaatggataaacaaagtgtggtataaacacacaatgaatattatccagcctttcgaaggatggaaattc

SEQ ID NO: 288796 - DNA, 2321 bp, Homo sapiens
aggcagatgctaagagaagggactggaagagaaaacagggtccctattttgagcagccgttgcagtggaaggtcacggaggactgccaagtgcagctgacgtgcaaggtgaccaacaccaagaaggagactcgctttcagtggttcttccagagggcagagatgccagatggtcagtatgacccagagacgggaacgggacttctctgcattgaagagttgtccaaaaaggacaagggaatttacagagcgatggtttctgacgatcgaggggaggacgacaccatattggacctcacgggtgacgccctggatgccatcttcaccgagttgggcaggattggtgccctctctgcaactccactgaaaatccaggggaccgaggaagggatccggatcttcagcaaggtcaagtactacaacgtggagtacatgaaaaccacctggttccacaaagacaaacgtctggagagtggtgatcggataaggacgggcaccaccctggatgagatctggcttcacatcctggaccccaaagactcagacaagggcaaatacactctggaaatagctgcagggaaggaagtccggcagctctcaacagatctctcagggcaagcttttgaggatgcaatggctgaacaccagagactgaaaaccttggccatcatcgagaagaatcgtgccaaagtggtgagaggtctgccggatgtggccactatcatggaagataagaccctgtgcttgacttgcatcgtctcaggagaccccacccctgaaatctcttggctgaagaatgaccagcctgtcaccttccttgaccgataccgcatggaagtgagggggacagaggtcaccatcaccattgagaaggtcaacagtgaagacagcggccgctacggcgtcttcgtcaagaacaagtatggctccgagacgggccaggtcaccatcagtgtgttcaagcacggggacgagcccaaggagctgaagagcatgtgacagcgtgtgtccaggcacagtctgagtctagtctgcatggaccagtagggacaacctgtaccagggtcacagcctggcacaggctacaggggtggggcagaaggaaaggggacaagatagaacccaggatgtgagggtgggggtggagcggatgcaccaaagtggagaagcaaagatctttctggggtcctgagtggcttccaggagagcgggatgaaccctggacctggagtaggagacccggatgcactggggctatctaacagtactggcatctgataggtagaggtcaggtacgctgctaaacactgcagctcccaccacatagaattatccgaccccagatgtcaaaagtgccaagggccatgagccctgccataaactgatacatcgcacccctcttttaggatcccatagtttcaattcatgtaagttcaacagacacctgaagtctagcatgtgggaggctgaggatggagctgggaacacaaaggcagctgataagcaggttctgcttgcaaagaggcctcagtccagtgggagaaacagacctgggcgcaaacaactccaggacaaggcaggacatgataaagattataaagcaggtccaaggaaagtgccgccagtggtccaaggagggagacagagggtcgtcccaacagggggaggtagggctttgaaaacaccttcatccaggctgggcgaggtggctcacgcctgtaatcccagtagtttgggaggccaaggcgggcagatcacctgaggtcaggagttttagaccagcctggccaacatgacgaaacccggtctctactaaaaatacaaaaattagccaggcgtggtggcaggtgcctgtaatcccggctattcagaaggccgaggtgggagaatccgttgaacctgggaggcggaggttgtgatgagccaagattgagccaaaaaaaaattagcagaattggtgttgggccctgaaaaattagtccgattttgtggtggtaatgggagaaggacatcccaggagcagggtctggtgggaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaaaacca

SEQ ID NO: 288797 - DNA, 473 bp, Homo sapiens
aggtccctcccccaacactggggattacaattcaacatgagatttgagtgggagtacagagccaaaccagatcacccctcttcctgcaccaggcatccttgaaagggggccataatgataatgaagcccagcatttcacaatatttaccctgcgccaggtactgttctggcatttttcatatgtgaggaaagggaaggaggaggctaaggctgcccaggaggccttggataccaggcttggagctggtaacctccagggcttccagcacggggcctctgcctggtgtgacagataccggctggcctcacttgatggatctcagtactgagctgggcatttctctgccccccaacttttttctttttaaaaataagatggggagtgttcataaaattatagatgtttgttgtaaaattttggaaaaccctggaaattatagagaaaataaacataatctatactcccaaaacca

SEQ ID NO: 288798 - DNA, 633 bp, Homo sapiens
tgatgcctaaatggcctcagggaagattcatccttctcctctgtctccccagccctctctgcaactccactgaaaatccaggggaccgaggaagggatccggatcttcagcaaggtcaagtactacaacgtggagtacatgaaaaccacctggttccacaagtaagtccgccttgccccagaaccccagccaggctggaaaggattcagcacctgacccatgggggcctccctcccttctccctgcctggtcctccaagcagagtttctggtcccccaagcagagcctggtcccaggggttagcagagacagagtctcttcctggtcttgctgtccacagaaggagttgaggatagagattagcagtgggaggagtagaaaggctttgccgagatccccagggaaggtgggaaccttggcgggacaacatttttctggaaactctatggccacagcaggatcagtctctgggcagcagctgggaactgggggagaaagggatgcagggacaaagaagagccaagtggtcaggtgggtcaggggacccttgtgggcctctgcagacttagcaaacttggtcagccaggcttaggggaaacatgcaggaaaagggtctgtggggctggccactaa

SEQ ID NO: 288799 - DNA, 993 bp, Homo sapiens
caggccttgagtgtactgcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagaggcaagggagaggttgttaccaggggacactgagaatgtacatttgatctgccccagccacggaagtcagagtaggatgcacagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatcaaaaaaa

SEQ ID NO: 288800 - DNA, 553 bp, Homo sapiens
gggctgggccctcttgtttcagaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctgggtcttgaaatgcaaataaggaaccacttcacacttcctaggatggatacaattaaaaaacagaaaataagtgtcactacggatgtgaagaaactggaactctcatgcgttgctggtgggaatgtgaaatggtgcagccactgtggaaaacagattggtgatttctcagaaagataaacatagaactgtcatctgacccagttattccactcccaggtatgtatctgaaagaatggaatgatagctgtacacccatggtcatagcagctttattcacaatcgtcaaaaggtggaagca

SEQ ID NO: 288801 - DNA, 287 bp, Homo sapiens
ggaattgtcagcgggctcaccctgaatgaatggttttatcctgctgccactgtgatggatacaattaaaaaacagaaaataagtgtcactacggatgtgaagaaactggaactctcatgcgttgctggtgggaatgtgaaatggtgcagccactgtggaaaacagattggtgatttctcagaaagataaacatagaactgtcatctgacccagttattccactcccagattaagaagactaaagctgaggcaagtcagataacttgcccagagtcaaaaaattactg

SEQ ID NO: 288802 - DNA, 910 bp, Homo sapiens
caggccttgagtgtactgcctccctatgcagagtatctgcaggtggtgaactatggcatcggaggacactatgagcctcactttgaccatgctacgtcaccaagcagccccctctacagaatgaagtcaggaaaccgagttgcaacatttatgatctatctgagctcggtggaagctggaggagccacagccttcatctatgccaacctcagcgtgcctgtggttaggaatgcagcactgttttggtggaacctgcacaggagtggtgaaggggacagtgacacacttcatgctggctgtcctgtcctggtgggagataagtgggtggccaacaagtggatacatgagtatggacaggaattccgcagaccctgcagctccagccctgaagactgaactgttggcagagagaagctggtggagtcctgtggctttccagagaagccaggagccaaaagctggggtaggagaggagaaagcagagcagcctcctggaagaaggccttgtcagctttgtctgtgcctcgcaaatcagagtacaaaggaggggggagtggaggcctgagagggaagtttctggagttcagatactctctgttgggaacaggacatctcaacagtctcaggttcgatcagtgggtcttttggcactttgaaccttgaccacagggaccaagaagtggcaatgaggacacctgcaggaggggctagcctgactcccagaactttaagactttctccccactgccttctgctgcagcccaagcagggagtgtccccctcccagaagcatatcccagatgagtggtacattatataaggattttttttaagttgaaaacaactttcttttctttttgtatgatggttttttaacacagtcattaaaaatgtttataaatcaaaaaaa

SEQ ID NO: 288803 - DNA, 404 bp, Homo sapiens
gggatcacggcaggaagggggcaacgtggatggacacctgcaccctgtgtgggggtataaatcaccctacagggcgctcgtcacctggccagccagagccctaggacccagccgcccctgctcctcactcactgtggcccccagccccactgtttcacaacaccccagctcgttcgtgccctgaggagagggaccatccgtccccacacccggtccacagcaccgcacccgactcagccccagcatcgaccagaagtccccggccctcagaccggccgcccagagacagtgggagtgaggaggccacacaccgtccaggttgaatcactgcgttttactgagtgcacaggtccacctggcgtccgaactcgtccccgtggcagcagggatccccagaaccttcc

SEQ ID NO: 288804 - DNA, 1234 bp, Homo sapiens
agcggaagcccttcatagcggccggccgcttattcctgtgcgagtaaggagcgcccaggccaaccctccggctgcagtctgaggggcgggggagaggtacctgtttgggctccgtgggcacgggcggcggcgggggcaccgcctgcacgggtccggccggcatgactgcgacgctcagggctgccagtccgcctcggtgtcggtgagcggtgccgcctcaagacagcctccccgctcggtcagtacgacgagctcgcaagatggcggcggccgagcgagttgcggccgcgaaggtacgactggcgcacttccgggaccgtcccctcgccgtgacgcgcttcccgcccctccccacgggcaccgcggcgtccgacgccgttgccaaggcagcggcctgagcgcccggctagggcttttcggggatcccggtggccgcaggcgcaccgggggcagttccgggagccgaccagacacgaaggctgaagccgcgacgccgaagacagggtctgaagagctactcagagccaaccctgcactggagacaggaagccgggcacctggatgagcctctgacccagagccctggagcccataggctcgtctgagaactagacacactcagtcactccagctccacgggcagacacctgcacagaggatctgtgaggatggcgcacctgctgggcagccaggcctgcatggagagcctgcgcacagacctcaccgacctgcagggtgccatcgtagaacgtcttctcccgcgccgggcctgtgcgcttcccctcctggaagttccctgaccgcatggcctgtgacctcgacatggtggccctgctggagcactatgaccatgttccgggtgaccccgagttcacgcagctgtcccatgccgtgctgctggagctggtcatcgacaggctcctgctgctgcttcaaagctgtatgagctacttggagaaccttggctcagagcagatgatgccccctgcacaggctgcggggccctgcatgtccgtggggctcacggtgcggcgcttctgggacagcctgctgaggctgggcacgctccaccagcagccactcccccagaaaggggcaaaccaaagggagactcccacctccaagcccaccaccaagggcgagccagccaggagccctgaatatctgactaccaagttaatcaagccctcctccccagtgctaggcttgccccagacctgccaagagccagaga

SEQ ID NO: 288805 - DNA, 578 bp, Homo sapiens
ctgtcccatgccgtgctgctggagctggtcatcgacaggtgagggccttgaccaagcctggtcatctcaggatgccagcacctgcccctgaaaccagtggcagctacggaagcccctccagaggcaggggtgatgttggaacaacagtcaccattgagtacctgtcggggccacatcagctcaggactttcaaagtggtcttaccttttatcatgtgtcttgtgttgtgtgctgtgctatcctgtgttaggctctcctagcctgtccacctcaggcagttgatttccattccatcggtctctgtggcaccacagctgtgaccacggtctctcagcctctcccagctgcctcctcagggtttctatgttggggaccccatagttgcttctcagagtttccattccgggctctctttcctgttgtcctgtgggttgtgctgttccctctgcatatcacaaggccggacacgggatgtggttttccaaatcctgacccgctgggaagagccttgctgattctcctgcagcctcatcacttctaagctatcattaaagttaacatggttggccgggcatggt

SEQ ID NO: 288806 - DNA, 1057 bp, Homo sapiens
aagtaagcttttgttatttattacttttgcttttaatataattttttaattgtaagcttacatagtttaatttttaataaaggctgtgtttagcaccagctcacaaatactctaaaaatttaacaattggctcttaagagttgatacaagccggctgctacatgctattgttgtctgggatttttccaggagaaaatactttgtaaatgacaaagaactcgggattattactgcatccaagacatcaaaatggcaaatcttattgatttgattctgttttgaaaatattcaatagaaatactattgtaatttgtctgattaaaagataaattatgtgatttggattctgtcttacaaaattgctttccttgaaattttataaggtaaaatcactatattatgaatgatcaaaatttaatatgtgaagtttcaatgcacactgtatttttaggttatattattttgcaaagtaagaaattcccccatgtatttttatgtgtgaatataatggatgtttgtgttaagcacttagaaaagttttttgagacattctcccattatggctgcaggatttgcttaatgacgctgatacgtgccggaaaaagatgcaggccgcctccactctcatcgatgggctgagtggagaaaaaatccggtggacccagcaaagtaaagaattcaaagctcagattaataggtgggaatctgggtcttcttcataatcactctttctttgtgacattagagaacataaagtccatttccatgtgttcatctctgaatcccatcatctatgacagtgcgtgcaacttaaatcatgcactctcaggtgaaatactatagagggtgaagaagattttgtgaaatattttacatctcagctgtggttcagcactgtgggttttcagtatgagagtgcttttgatattgtttggatttgccagagccgtctccactccagttctctatgcttcacctcaatgattttgaaagtgtggatcaatggtttgttgtggatcaatggtttgttgtaaatgcaaggctgtcttctgctggt

SEQ ID NO: 288807 - DNA, 14030 bp, Homo sapiens
tcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctgggtcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacagaagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcgtttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtgaaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccacatctccctgcagtatctgacaacatcaatgaggtgacatttcatacaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaaactaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctatgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggagacagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcagtactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctgtgcta

SEQ ID NO: 288808 - DNA, 10645 bp, Homo sapiens
tcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctgggtcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacagaagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcgtttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtgaaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccacatctccctgcagtatctgacaacatcaatgaggtgacatttcatacaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaaactaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctatgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaataggtgggaatctgggtcttcttcataatcactctttctttgtgacattagagaacataaagtccatttccatgtgttcatctctgaatcccatcatctatgacagtgcgtgcaacttaaatcatgcactctcaggtgaaatactatagagggtgaagaagattttgtgaaatattttacatctcagctgtggttcagcactgtgggttttcagtatgagagtgcttttgatattgtttggatttgccagagccgtctccactccagttctctatgcttcacctcaatgattttgaaagtgtggatcaatggtttgttgtggatcaatggtttgttgtaaatgcaaggctgtcttctgctggt

SEQ ID NO: 288809 - DNA, 7285 bp, Homo sapiens
tcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctgggtcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacagaagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcgtttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtgaaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccacatctccctgcagtatctgacaacatcaatgaggtgacatttcatacaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaaactaaatctcaatcccaaaatgcagctcttggagtgcaactatattgtgcaagtaagatttttttttgtacatttactacttcgattttgatttttttttcactcagttgcagtttacagccatctgaaatagaaagttcagacagtccataaaaatcatttgatgatgtggctgtaaaagctctgataattttgatttctattaaagatcttcttaatgat

SEQ ID NO: 288810 - DNA, 405 bp, Homo sapiens
taaaaactctgttaaaatggaaataaggtggcccctctcctttcttgtagcagttttcatttagatgctcatcaattttatttcttttgttttctctcacatacaggtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtaagtccctggcattttttaatttgaaggggtcatttgtaactcagtctggcaaagatggtgcatttcattttctctcctaatctctctcctttccccctttttttattttactgtgaaaaatagtgtcgcttcctg

SEQ ID NO: 288811 - DNA, 446 bp, Homo sapiens
ggaactgcaaaaactgtcatggttaaggcctatttgaaaaaatatgatcctgaagtacagctatccaaaagtctaaacttttcatctgccacagaaccaatgatgtttcaggtgaaatccatcatttgctgtaatattataaacataatacattttaaattagtggttacaataaaatgtgtacgcatataaaatgtgaaaatattatatattcaaaagaaatcatgctgcacttggcattcagctgtttagctttcctaaggctaaggttgaaggcaaatccaaatagcatactttgacctaatattgagactgcagctgaactttggagcatatctactgtaatgtaaatgaaggataaaactccaatgccttatttttaaaaatttaacaacatatattttaataattatatgtatacttattaaatgcgtaagtaaattata

SEQ ID NO: 288812 - DNA, 14138 bp, Homo sapiens
tcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctgggtcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacagaagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcgtttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtgaaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccacatctccctgcagtatctgacaacatcaatgaggtgacatttcatacaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaaactaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctatgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggagacagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcagtactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctgtgcta

SEQ ID NO: 288813 - DNA, 4442 bp, Homo sapiens
aagtaagcttttgttatttattacttttgcttttaatataattttttaattgtaagcttacatagtttaatttttaataaaggctgtgtttagcaccagctcacaaatactctaaaaatttaacaattggctcttaagagttgatacaagccggctgctacatgctattgttgtctgggatttttccaggagaaaatactttgtaaatgacaaagaactcgggattattactgcatccaagacatcaaaatggcaaatcttattgatttgattctgttttgaaaatattcaatagaaatactattgtaatttgtctgattaaaagataaattatgtgatttggattctgtcttacaaaattgctttccttgaaattttataaggtaaaatcactatattatgaatgatcaaaatttaatatgtgaagtttcaatgcacactgtatttttaggttatattattttgcaaagtaagaaattcccccatgtatttttatgtgtgaatataatggatgtttgtgttaagcacttagaaaagttttttgagacattctcccattatggctgcaggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggagacagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcagtactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctgtgcta

SEQ ID NO: 288814 - DNA, 1225 bp, Homo sapiens
attttaaagacttaaagtttaatttttattattaaaagggtatgattatttttactaaaattaataaaaagattaactgttactaaattaaagctccttcaaaaacataaatgtattctttagagagttaaaaaaagtagcaataaaatacatttttaatttagttaagcttacttaactaatgatcaaatagattaagttgtataaaattttacaaactttatatttttgcatacacttatcttcctggcatttttgaaataaaaaaaatacaagtgcatagggcagaggaggcgattcagttacttctgctatgttattaaatctctggtaaccactatacaatacaatacaatacaatacaatacaatacaatacaatacaatacaatacatgtagactcagcatccaaactttattttaccttcaagttctacctgataaagtggtggaataaagatggtattttccataactgtttaataataatcacatgttttatacccattgctttgaagaagaaaccttaagcaactagaaatgtcaatctaaaaggcagaaaagctggaaaaatctcatgaagactagaagatttacactcataagatcatgtaaatttatttggatatgctgaaaaaagagggggtataaaatctaaagtttggtaaatctttgctttacagggcttcaagttatagatttttcttttttccttttctcttcccctttctctctctttctcttttttatttttgccatttcttctcaggagcccctgcaatttcaaaccttggaattgaattggatttgaggaggaaaacccatattcagctttaattcaaatgaattttactactttagacaaagactaatttggatcatgattattggcctgtgtcccacccattattcacatatagaatgggttgcattatcctctccttggaaatatctttcaaagtgggtaatgagaaaactacttagaagactgtgctgaaggaaatgatggcatgaacaactctagataatttttgtttatttggatataacgtgaatgggcccataccataaactcctattaagctgaatcaccaaaaaaaaatttgatatgaaagtcatacattgaaaaaattcactcttaccactgatttgattgatactgagcctgtaaatatttatttatatgatgtttggcactttattttataaaactaccctttactta

SEQ ID NO: 288815 - DNA, 564 bp, Homo sapiens
ataccttctgctatggtttgaatgtcctttcgaaaactcatgttaaaaattatgattttttttttttgagacggagtcttactctgttgtccaggctggaatgcagtggtgcaatctcagctcactgcaacctccatctcctgggttcaagcgattctcctgcctcagcctcctgagtagctaggactacaggcatgcaccaccatgcctggctaatttttccacacccagccaaaatttacgattattattattgttttggaagcagggtcttactctgtagtccaggctacagtgcattgatacaatagctcactgcagccttgaacttctaggctcaagtgatccttctaccttggcctcccaaagtactgggattacaggagtgagccaccatgcctggccacatgttgaaatttaattgccactgtgacggtaataggtgattaggccatgagggctctgccctcatgaatggattcatgttgttataggggaagttggtttgttattcacaagaggggctgttaaaaaagtgagtctgggctaggtatggtggctcat

SEQ ID NO: 288816 - DNA, 335 bp, Homo sapiens
agcaactctccccacttgaacccctcaagccaactgtgtgaagtcccaacacacagttggcactacaggtgtgtgccactgtgcaggcttgcacctagtgaagactgtctaggggagaatgattacacaatttaaaaaaagtctattcaaatattttaacacttcttttcaggtagttatagctgatccaaagcagcgatgcagctggacatggtgattaggccatgagggctctgccctcatgaatggattcatgttgttataggggaagttggtttgttattcacaagaggggctgttaaaaaagtgagtctgggctaggtatggtggctcat

SEQ ID NO: 288817 - DNA, 881 bp, Homo sapiens
tctggggttgcgaaccgcccccgagcctggtacaggctgggattgtagtcctgcagccttgtggccgaagggctgggactggccatgagattacatgtcctagcatgctcagccaggcgcgcgcagctctgccccttcctccagtgatgcgcacagtccctgatccctgtgcacgctgggattgtagtcctgcagccctgcgatcacttgcaggtaacaagaaatttcagcttccggcatgatgggcgaaggcccccaccttcagcctcgctcctccatgccttcagagctgttccgccatgcagacggggagcctgcctgttctttaacctctcctacctgatgggagaggacaagctaccaggacagcttgtctcaccaagaaattgtgataccgcatcccccaacgtgctggcttcctgacttccaaagttgcggcaaggtaagaagaactacagaggaagaacctaatgcagacgtttcccaggagactttaactgaagtatcagcaaactgaaagctaggacgcttcagacataccagtgggcctaacctttttcacaaggagctctggcctggccaacaagaatcacctttggtgcttcagtgcagtgtcaccatcacctgtttgaaatgcagccagatggagtctcattctgtcacccaagctggagtgcagtggcgcggtcttggctaacagcaacctccgcctcccaggttcaagcaattctcctgcctcagcctctcgagtagctggtattacaggcacgcaccaccacgcccagagtttcactcttgttgcccaggctggagtgcaatggctcgatcttggctcaccacaagctccaactccaggattcaagcggttctcctgtctcagc

SEQ ID NO: 288818 - DNA, 448 bp, Homo sapiens
gctcagaggtgatttttattttccattcaggccaagtaaatccaatcagccattagctcagtgaagatttgtcaaatccaagccacacaccaaatcacgttatgctaaatgtgaaaatgtcctcattactgggcaccaaggtgttttaaattcagagtctaatcaaaacagctcatggggttctgtccatccagctaggacgcttcagacataccagtgggcctaacctttttcacaaggagctctggcctggccaacaagaatcacctttggtgcttcagtgcagtgtcaccatcacctgtttgaaatgcagccaggtaacatgtaccattttatttgctttcagtatcacagtctatcttctaataagaaacctaggtttatttctatgtaaagtgtaaaagaaatttaaactcatagaagcagagagtacaataatgaaaaaaaa

SEQ ID NO: 288819 - DNA, 864 bp, Homo sapiens
ctcagatgatccgcctgccttggccctccaaagtgctggaattataggcatgagccaccgtgcctggcctgttccatgcattaaaaaaaaataaaaaaattaaaaaaaatcagtgagaacaagaagaaatgtaaatgctgggcttttcatataaatccagggaattatgggacagttagtacccacctcccagggtattataaggataaattcatgtcatcttcccagctccgtagcgtgcttctgagcacacagagcatgctccataaacattgcattaacgcatgtgtgcatgttgttttccaaatgcagacttactcagacatgagctgccttctccagcctctgtaaagtttaaaggaccagcagagtgtgccatgttttaggatagtgattggtggtttttattttggactgaaagcatttatgttgtgagaagagtataggtttaaggaactgtgtgctgtggcactttgtctagttgagtgctgctataagtgatctagggcaagtagggtcagcattagctgtgaatgaagccaatccatggacccctttcaaacctgcagaattggccaggcatggtgctcatggggttctgtccatccagctaggacgcttcagacataccagtgggcctaacctttttcacaaggagctctggcctggccaacaagaatcacctttggtgcttcagtgcagtgtcaccatcacctgtttgaaatgcagccaggtaacatgtaccattttatttgctttcagtatcacagtctatcttctaataagaaacctaggtttatttctatgtaaagtgtaaaagaaatttaaactcatagaagcagagagtacaataatgaaaaaaaa

SEQ ID NO: 288820 - DNA, 234 bp, Homo sapiens
gcttcagacataccagtgggcctaacctttttcacaaggagctctggcctggccaacaagaatcacctttggtgcttcagtgcagtgtcaccatcacctgtttgaaatgcagccaggtaacatgtaccattttatttgctttcagtatcacagtctatcttctaataagaaacctaggcctctggctgggtgtggtggcttacacctgtaacccagcactttgagaggctgagg

SEQ ID NO: 288821 - DNA, 347 bp, Homo sapiens
tcaggtgagtttctcctgtgcctgcctgggcgccagctgatctgagatgccgcagtgagtattgggggctctgagggtttcgcctccagggtgactctacccgtgccagccctcctcctgcccaccccagggctggtcagtgcaggtgcctgtcctggtgccagagctcagcccagaggcagggtccaggaatgggctgtgaggggtggcgaacttgcccctcccctcccccaggtgctgtccctcagctccattgttcttgggagtgaaagtccaatagaattttttttttaagtgagcatgtatatttattgtagaaaaatcgggaaatacaaaagtaaactata

SEQ ID NO: 288822 - DNA, 618 bp, Homo sapiens
tggcaacgggacgccgctcctgggtggcgagcaggcgcgtgtgtaggggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatg

SEQ ID NO: 288823 - DNA, 1075 bp, Homo sapiens
tggcaacgggacgccgctcctgggtggcgagcaggcgcgtgtgtaggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggctggagtgcaatggcacaatctcagctcactgcaacctctgcctcccgggttcaagtgattctcctgcctcagccttccaagtagctgggattacaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatg

SEQ ID NO: 288824 - DNA, 977 bp, Homo sapiens
tggcaacgggacgccgctcctgggtggcgagcaggcgcgtgtgtaggggtgagcgcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatg

SEQ ID NO: 288825 - DNA, 741 bp, Homo sapiens
tggcaacgggacgccgctcctgggtggcgagcaggcgcgtgtgtagggacgaagtttcactcttgttgcccaggctggagtgcaatggcacaatctcagctcactgcaacctctgcctcccgggttcaagtgattctcctgcctcagccttccaagtagctgggattacaggagttagaaatggagtcaatatatcttcaaaagcaccttggggcctgtttaactcaaggtcttgcagaagtggcaagagttcgcccagtggatccgatagaatatttagcattgtggatttacaagtataaggaaaatgtgaccatggaacaactgagacaaaaggaaatggccaagctggagcgtgaaagagaattagctctgatggagcaggaaatgatggagaggctcaaagcagaggagctcttacttcagcagcaacagctggcattgcagctagagttggaaatgcaagaaaaggagaggcagagaatacaagaactacagagagctcaagaacaattaggcaaggagatgagaatgaatatggaaaatctagttaggaatgaagatattctacattcagaggaagcaacactagactcaggcaaaacactagctgaaatcagcgatcgttatggagcacctaacttgagcagagtggaagaacttgatgaaccaatgttttctgatattgcattaaacattgatcaagatttgtaggaccaaccaacctaagagcaataaatg

SEQ ID NO: 288826 - DNA, 406 bp, Homo sapiens
gagagtgcagtgtgtgaaggcctgggggctcagggaggaaccattagcaattctaacattgaagggatggccacaggaagaggagcctacaagaaggatgagaatgcatagtaagagaagtagaagaaaggatggaacaataactactttgagaacataatttatggttatattcaatttgagtatcatttgaaatcatctgaaactcccaaaaagtttcattcatgtagtcacatagaagttacctaaagtttatttctttggcttgtgccttttcacagttctaattgtattaaggaatatttactttttgttttgcttttagattgcattaaacattgatcaagatttgtaggaccaaccaacctaagagcaataaatgtttttgtttgtttcaaatttcaaa

SEQ ID NO: 288827 - DNA, 450 bp, Homo sapiens
gcaccggaaaggcccgaactgtttttgggatttgttcccctagcttcgctgggtccggcgggcagaggcggttctgaccgttgggccttgggcgtcgagcaggactcacctgaggcggagagaggccgcttcgcgcctggggctcccgaaagcggccagctgtcctcctgctccccctgagcggggagcgctgcgtctcctgcgggctgcgggagacccttccagactcccgggtgggaaaaccacactgagcgccccgggaggttgccagatacaatactgtatctggcacccctgcccgggtgcccccgcccagttggctggctggctggctagctgtctcccaggtgtgggtaaggaatctccttccatctctgtggcaccttcttcacgctggaggcagctgtttctgtgggaaagggctttcttatgttgagccaagatgcctat

SEQ ID NO: 288828 - DNA, 698 bp, Homo sapiens
gtggcgagtcctttattttaatgccaaacttcaacttcctaagttttctcttccatccctgtctgtgaagaatccggggagtgtgtgagtgcaaatactagttttacctgcctgcggctgccactgcaacgcttccctctgggctaatcaactgaagctgagggagtgaaaaaagaacaaagaaatctgtgactgcttgtgatcaattagtaaacttaattttttagattaaaatgaaataatacatgcaaagcccttggcacagtgccttgcacataatacatttcggggttaagttgtgctagctattctgttattgattgtcttgccctttgttctctggaaggttggatcttgccatttggggatggccaatgggaaggctgagcaagacatcagagggtgggaggaaaggaggtatatttattttccttactccttctctgctgggcttctattttgtcactagctgcattcctttttatgaccacaactccagtctaatggccaccctcccataactagagttcataatcaaactaacactgccacctcctcaggcctaggaatggtcatggtttttcttctcaccttgcttcaggttcttttttccctactgttgcttgcgctagatgctccaccctcttttcttgttcctttaaggcctctctaaactgtcactttatgaaactgtcttc

SEQ ID NO: 288829 - DNA, 1133 bp, Homo sapiens
acggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatgggcgtgagagtgaagctgcgatcttgggacaccgctgggcaggaacggtccgaaggcgtccccatgcttattacagagatgctcagcctgcttctgctggttgacatcaccaacaaatcttctttcgaccaacatcaggggctggctcactgagaatcatgagtattgcccgagggacgtggtgaaccaatgcatggctaagggaaccaggcgggggaattagagcagcggaaaggagtagataccgatccgaaagaaagcgggaagaccctgtggccacggaggatccggggtgccctcccaggagacacgaacgcgcaaaagaggggggaatgtggggggaaccctcatgggacaccacgacggagaaggagataacggccgcgcaacaagagcgagaagccacagacagatacacagagaattattaggcacaagaagaaagacaccacacatggacacagtagacc

SEQ ID NO: 288830 - DNA, 791 bp, Homo sapiens
acggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataaggtaaacatctcctgtattcctcaacctaacgttggaagaggcgccagcaccaggagttttctccactcccctgactttgctttgggacttaatgagaaactagcttgtatctgtgagtctggggagccctttctgtctgatcctgtttcctgctcaaaacagagatgcgtgagctcttggggaagggctgccgccagaggctcagatggtcagaagcttcattcattcacttacatcatctgtgttcctttttcaccccct

SEQ ID NO: 288831 - DNA, 1898 bp, Homo sapiens
  misc_feature (1766)..(1766): n is a, c, g, or t
  misc_feature (1896)..(1896): n is a, c, g, or t
  misc_feature (1898)..(1898): n is a, c, g, or t
tgcagaaagggacggggctggcaaaggcctggtctacctcaccgatccaggtcgcgggggctcctagggggttccttccacagctggtgcgcgtgcgcaggagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggtcacccttcttcagatgcctggaaagatggagtttccctcttgttgcccaggctggagtataatgatgcagtctcggctcactgcaacctccacctctgggttcaagtgattctcctgcctcagcctcctgagtagctgggattagaggcacccaccaccatgcctagctaattttttgtgtttctagtagaaatggggtttcaccatgttggccaggctggtcttgaactcctgacctcaagtgatccgcccacctcagcctcctaaagtgctgggatgacaggcgtgagccaccacgcccagctgtcccttaacatttgaaatgtgtatatcacctcatttagctattctgtttctagaaacttatttttacaaagaaaattcacaaatgcacacgnaaatgtatgcatgaagatacttgtcacagcgttggttgtaataatatggaattaggtcaaatatttatcagtaaaagactaagtcatattgtgcatatactgaaatatgtgataaacctaaatttactgncn

SEQ ID NO: 288832 - DNA, 1821 bp, Homo sapiens
tgcagaaagggacggggctggcaaaggcctggtctacctcaccgatccaggtcgcgggggctcctagggggttccttccacagctggtgcgcgtgcgcaggagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggtcacccttcttcagatgcctggaaagggagaacacactgaaggaagcagaatgaggggcactaagcactgcaggagaagatggggatggcagactcagcctgaccaaagaaatcaatcacatcttgaatttctcttctgtgtggactctttgatgattgtgaagactagagatctggctgaagctcttaccacatgcattacagctataaggtacctcccctatgtgaactctctgatgaaagtgaactccggagctctgatgaaagttaccgtcaacttcatcacatccgtacagcttcttacctatgtggtttcttggatgtctatacaagtctgatctctgagagaagcatgctttacagatggagcattgacagaggttttctccaggttgatttctcttgtggaaaacacaccgtgagttccaataataaattcctttacatttattac

SEQ ID NO: 288833 - DNA, 3454 bp, Homo sapiens
tgcagaaagggacggggctggcaaaggcctggtctacctcaccgatccaggtcgcgggggctcctagggggttccttccacagctggtgcgcgtgcgcaggagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggtcacccttcttcagatgcctggaaaggtgagaattggttatataggaaccagaaaaaatgggacataaatttgccacaagaggctttcattcctgagacaatttacactgaggaggaagattttgaatgtagtgaaaataagaaaagctttgatattaattcagttagctcaatttgtgctatacaactgggaattccttcaagaaaggggtctccaaaatgtgataagtttaaaacttacttcaaatttaatttagactcagtaggtaagcaacattcagaatatgaatatgggaatgacttgagtttgagtacagatattcgacaccaaaaaagtcatactacaatgaattcctatgaatgttatcaatgtgggaaagccttctgccgaagttcatcccttattcgacatcagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaataataatgtaagaaaacatttgtcagatatccctcttaaatgatatcacagaatttaattgttggatagaaaaatcattggatagaaaatctgtttgaaggaatttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattagcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactctgta

SEQ ID NO: 288834 - DNA, 3280 bp, Homo sapiens
tgcagaaagggacggggctggcaaaggcctggtctacctcaccgatccaggtcgcgggggctcctagggggttccttccacagctggtgcgcgtgcgcaggagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggtcacccttcttcagatgcctggaaagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaataataatgtaagaaaacatttgtcagatatccctcttaaatgatatcacagaatttaattgttggatagaaaaatcattggatagaaaatctgtttgaaggaatttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattagcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactctgtacaccagaactgtgtcttctgtaaactacctcaggatcccatctggttcttgagccaagaagtatgacttaatctgccccaaaaaattcacactggagacattcccaattaatgatgatggtagctttttgtgaaggttcataccttattcaaaggcagaaaaggtatactggagtgaactcctatgattaaataatgtcaaaatctaaatttgtt

SEQ ID NO: 288835 - DNA, 1669 bp, Homo sapiens
tgcagaaagggacggggctggcaaaggcctggtctacctcaccgatccaggtcgcgggggctcctagggggttccttccacagctggtgcgcgtgcgcaggagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggtcacccttcttcagatgcctggaaagggagaacacactgaaggaagcagaatgaggggcactaagcactgcaggagaagatggggatggcagactcagcctgaccaaagaaatcaatcacatcttggtaaagtaagccactctcatttgtgtctggattagagtaggatgaacatcagaaaagggctctgtgatcagcctcctttactaggctttaatgtaactgattttccctttattatctcctaaactcctaatttagaacagcatataataaagcctttttgtgcagctttctatcca

SEQ ID NO: 288836 - DNA, 4176 bp, Homo sapiens
ctccagcctcctggagaagatgacgtccagcgacaaggacttcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacggcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcgctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagttacttctttcctctaaacga

SEQ ID NO: 288837 - DNA, 583 bp, Homo sapiens
atccagtggccccaagctacatgtttgcactcccacctggccacactcagccagagctgccccagcagcccccttcactcatccccagcatctgcctgactggtgggcatctgagcttgagaacgactccctccctggtgcttttctgatcctccttgggtcatccaagtgtagttggcaaagaaagtgtcaccatttgaggaaacagacccagagagggagagactctggcaggacttcacggtggtctgaacttgggcttcaggtttcagttgtggggcctctgctctttcccagggctggctgctgctcttgctcctgcaccatttcactaagaaccatctccttcctctgggcagatgctgaccttcatcatggttgcccggctggccaccctgtgtcctgcacctgtcctgcagagggtggaccgactcattgagccactaagggccacctgcactgccaaggtaagtccctggcccagccctagcccaggccctggagcacctatggagtccagttacccttactgagcacttcctgcagtgcaggtgatgttgtgaaagtgcttcatttaatcatt

SEQ ID NO: 288838 - DNA, 4939 bp, Homo sapiens
gcagacagaggtgctgtgatggggtgcactccgggagccagcagcaggtgtgtggggaggaaggtgatggattcaagctggggcatgttgaacttgaggctcctgggaggcactcactcaaccacacactccatgagggcagctcccaggatcagtctgtcttgttcaccctggcttccagcacagtccctgtcacttagcaggtgaacaggcaaacaaatgaaacctaggagagggggttgggtaggacatagaaataagggagggtaaggtcagcgtgtttctgtaaagtgagaaagaaaaggtctcaagatgtttacaggacagaaaatgcacgggcctcgtttgaaggtgtggatagaagctgctgaggcaggcaggagctgtgctgtgtgcgcagaaaccattgtctggtgttgcctcttgtcttgagcccagagctcagcatctccaaaggcactagggagccatggaaggagttaagcagaggagtgaccaggtgagaagtagactttatactgctctggtctcagcgaggaggatggacagaaggggatggtattgaggcaaggcctagacttccaagaaatagggacagccttactagatcctctatgctttcccctatcaggtctttctccctaggctgggagcacaggctttgcactgctgagaagtccctttctctctccgctttctctcatgtaacaaaagtaattaaaataattcctcctcacagttgcagggcacctcttttgcaagggccattgagttgccataatcctgggaaggaggccgggagagaatggggagaggggcggagcctggcccaggttgcccgcggagtgcgatcggcctgatgccccctcgtgctccccaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacggcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcggagagttcatggagagcctgcaggacccagacctgaacgtgcgccgtgcgactctggctttcttcaactcagctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagttacttctttcctctaaacga

SEQ ID NO: 288839 - DNA, 4511 bp, Homo sapiens
cgatgttggcatagccagagagtatctctttctggccaaacaggggctcccctgatgatctgaggccttttcctcagcacgtgtggccgcaggagcatgaggggacataaaggggcagcctgactcaggctgaaccttgtgcccttggattcaccttcccactccctgctcagcctgggtcctctggtggccaaagtgaaggagtaccaggtggagaccattgtggacaccctgtgcaccaacatgcggtcagacaaggagcagctgcgagacattgccggcattggcctcaagaccgtcctctcggagctccctcctgcagccacaggctccgggctggccaccaacgtgtgccggaagatcacaggccagctcaccagtgccattgcccagcaggaggatgtggctgtgcagctggaagccctggacatcctctctgacatgctgagcaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacggcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcggagagttcatggagagcctgcaggacccagacctgaacgtgcgccgtgcgactctggctttcttcaactcagctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagttacttctttcctctaaacga

SEQ ID NO: 288840 - DNA, 4804 bp, Homo sapiens
gcagacagaggtgctgtgatggggtgcactccgggagccagcagcaggtgtgtggggaggaaggtgatggattcaagctggggcatgttgaacttgaggctcctgggaggcactcactcaaccacacactccatgagggcagctcccaggatcagtctgtcttgttcaccctggcttccagcacagtccctgtcacttagcaggtgaacaggcaaacaaatgaaacctaggagagggggttgggtaggacatagaaataagggagggtaaggtcagcgtgtttctgtaaagtgagaaagaaaaggtctcaagatgtttacaggacagaaaatgcacgggcctcgtttgaaggtgtggatagaagctgctgaggcaggcaggagctgtgctgtgtgcgcagaaaccattgtctggtgttgcctcttgtcttgagcccagagctcagcatctccaaaggcactagggagccatggaaggagttaagcagaggagtgaccaggtgagaagtagactttatactgctctggtctcagcgaggaggatggacagaaggggatggtattgaggcaaggcctagacttccaagaaatagggacagccttactagatcctctatgctttcccctatcaggtctttctccctaggctgggagcacaggctttgcactgctgagaagtccctttctctctccgctttctctcatgtaacaaaagtaattaaaataattcctcctcacagttgcagggcacctcttttgcaagggccattgagttgccataatcctgggaaggaggccgggagagaatggggagaggggcggagcctggcccaggttgcccgcggagtgcgatcggcctgatgccccctcgtgctccccaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacggcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcggagagttcatggagagcctgcaggacccagacctgaacgtgcgccgtgcgactctggctttcttcaactcagctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagttacttctttcctctaaacga

SEQ ID NO: 288841 - DNA, 4255 bp, Homo sapiens
gcagacagaggtgctgtgatggggtgcactccgggagccagcagcaggtgtgtggggaggaaggtgatggattcaagctggggcatgttgaacttgaggctcctgggaggcactcactcaaccacacactccatgagggcagctcccaggatcagtctgtcttgttcaccctggcttccagcacagtccctgtcacttagcaggtgaacaggcaaacaaatgaaacctaggagagggggttgggtaggacatagaaataagggagggtaaggtcagcgtgtttctgtaaagtgagaaagaaaaggtctcaagatgtttacaggacagaaaatgcacgggcctcgtttgaaggtgtggatagaagctgctgaggcaggcaggagctgtgctgtgtgcgcagaaaccattgtctggtgttgcctcttgtcttgagcccagagctcagcatctccaaaggcactagggagccatggaaggagttaagcagaggagtgaccaggtgagaagtagactttatactgctctggtctcagcgaggaggatggacagaaggggatggtattgaggcaaggcctagacttccaagaaatagggacagccttactagatcctctatgctttcccctatcaggtctttctccctaggctgggagcacaggctttgcactgctgagaagtccctttctctctccgctttctctcatgtaacaaaagtaattaaaataattcctcctcacagttgcagggcacctcttttgcaagggccattgagttgccataatcctgggaaggaggccgggagagaatggggagaggggcggagcctggcccaggttgcccgcggagtgcgatcggcctgatgccccctcgtgctccccaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggggctcacctggaccgcctggtgcccctggtggaggatttctgcaacctggatgatgatgagctccgggagtcctgcctccaggcttttgaggccttcttgaggaagtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacggcccccgaagggatggctggaggccatggaggaacccacccagaccggcagcaacctccatatgctacgtggacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtcggccacacacccggagcaccgtcatcacagcggtcaagttccttatctcggaccagccccatcccattgaccccctcctgaagagcttcatcggagagttcatggagagcctgcaggacccagacctgaacgtgcgccgtgcgactctggctttcttcaactcagctgtgcacaacaagccctcgctagtccgggacctgctggatgacatcctgcccctcctctaccaggagacaaagatccggcgggacctcatccgagaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccggatgctgaccttcatcatggttgcccggctggccaccctgtgtcctgcacctgtcctgcagagggtggaccgactcattgagccactaagggccacctgcactgccaaggaaccaaacgccaacagtgtggcctggaacacccagtgtgaggacatgcatgctctgcttctcgggaggaggctacctcaacatcaaagccagcaccttccctatgcaccggcagaagctgcagggctttgtggtcggctacaatggctccaagatcttctgcctccatgtcttctccatttctgccgtggaggtgccgcagattggagaggacgaaggccctgaggtccaagaacattgaaacctgacagtggatgccaacagctgtggggaggagcctggtgagacgcccatgctgccacgtgcccagcaacgttggagcctgcagcgcttttcccctgccctgctctattttatcttttttaataaagatggctcctgat

SEQ ID NO: 288842 - DNA, 1490 bp, Homo sapiens
gcagacagaggtgctgtgatggggtgcactccgggagccagcagcaggtgtgtggggaggaaggtgatggattcaagctggggcatgttgaacttgaggctcctgggaggcactcactcaaccacacactccatgagggcagctcccaggatcagtctgtcttgttcaccctggcttccagcacagtccctgtcacttagcaggtgaacaggcaaacaaatgaaacctaggagagggggttgggtaggacatagaaataagggagggtaaggtcagcgtgtttctgtaaagtgagaaagaaaaggtctcaagatgtttacaggacagaaaatgcacgggcctcgtttgaaggtgtggatagaagctgctgaggcaggcaggagctgtgctgtgtgcgcagaaaccattgtctggtgttgcctcttgtcttgagcccagagctcagcatctccaaaggcactagggagccatggaaggagttaagcagaggagtgaccaggtgagaagtagactttatactgctctggtctcagcgaggaggatggacagaaggggatggtattgaggcaaggcctagacttccaagaaatagggacagccttactagatcctctatgctttcccctatcaggtctttctccctaggctgggagcacaggctttgcactgctgagaagtccctttctctctccgctttctctcatgtaacaaaagtaattaaaataattcctcctcacagttgcagggcacctcttttgcaagggccattgagttgccataatcctgggaaggaggccgggagagaatggggagaggggcggagcctggcccaggttgcccgcggagtgcgatcggcctgatgccccctcgtgctccccaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggtaagggggcagggggcggggcctgggctggcatggtgggcggagcttagggtgagccaatgactcggtaaaggggcggagcttgggccgcagtgcagccagggcctaagggtgggccgtctgccttggtagggaggatggggcggggcctgggctgatgtggtgggtggggcctggggcgggcggctgaagcccctgaaacgcagaggttggggccggatagggcttgagaggcgcagggcgggccctgagctcgacaaacccccaggcctgagcccctgctgagtgcagacggttcagagaagggggttggttcaatcacttatgagacgtggaggctggct

SEQ ID NO: 288843 - DNA, 460 bp, Homo sapiens
tttcaagataatgctgaggcaccacattttaaattctaaagacagtcccatagcataggttctgttacgactcccattttacagatgaggacattgaggctctccaaggtcccacagtaaattggtagagctggaatggaagccacatcagctcaagcccacattcttatctggcctttgaagggttgtttgtgcctggcacaaagtagatgctcaccacacccagcttacccccattcagccagttctgcacgtgcacagtaaccagatggccggggtggtgagggaggtgactttgtgctttggctgtgcatcccccacgcccctcatgttcttctgccaggagagttcatggagagcctgcaggacccagacctgaacgtgcgccgtgcgactctggctttcttcaactcagctgtgcacaacaagccctcgctagtccgggacctgctggatgaca

SEQ ID NO: 288844 - DNA, 565 bp, Homo sapiens
ctctatctaaaccccagttttctcatctctataatggggaaataatccctgtctcaaaaggtcgtcatgaagctaaaataagattatgggtttgacatgcttagccccatccgtagcactcagtagatgcccattaaaaggtagggaatgttccccatagggtatctataaatgctgatcatcaaaaagtgaagcacagtgcccagctctctctcctccctgtcccttctcccccgagccacagacctgtcctgggagatgagggttccacgtgtgtcttgttcctgccccagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacggcccccgaagggatggctggaggccatggaggaacccacccagaccggcagcaac

SEQ ID NO: 288845 - DNA, 453 bp, Homo sapiens
cagaggttttcctagtttaaataagaaaaaagaagcttttatgtaagttaaatcattacttcagtatcactccaggtgcagcctttagatgctttatacatttttaaaagtcatctatcactctatattagaaagaatgcagggcaagtatatcttaagcctcatctgaatgctctgacacaaagtccccatgttatgttaagcagtttactaactctttttgggcttcatcagaacattcaaagaatggactatagcatctctcaagcctcctattttagaaattgtaatataagaatatgcatatgttcacactgaattaaaatagttattagataacaattatgattatacttttagggatcattcttttcacatccgtaaaagttaacataatgaggcaatattattatccagttttaaagtcttgcgcgaagtgacagtttgaaggtg

SEQ ID NO: 288846 - DNA, 983 bp, Homo sapiens
gaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtaccttccttcaaataaagaaatttggtacct

SEQ ID NO: 288847 - DNA, 755 bp, Homo sapiens
gaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctgagacacattttaataaatgttttcttatgaaagagatcaaactttcataaggagaaagaagagtattcatatag

SEQ ID NO: 288848 - DNA, 847 bp, Homo sapiens
tgtcagcaattcaagactatctttcctaccctctgcagtgcctctttcagctatccaggtactgagtgttcatctgattttttgttctcatgtatgtatatgtgcttttttgtgtgtagatagttgtcaaatttggtgttcctgtagggggatgactaatggaaactttattcagccactgcgctcttctccttattctccttatattattgtcaaggaaccagactagactgggtggaatttcttcctggatggagaataatttttaccaatataattgttaaaacaaagcaaaaatatgtatcactgtttcatgacttagttgcaggattcataacccaaaccagtaaactcgtactctcctttcttggacctcttcagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctgagacacattttaataaatgttttcttatgaaagagatcaaactttcataaggagaaagaagagtattcatatag

SEQ ID NO: 288849 - DNA, 678 bp, Homo sapiens
gaaggaagaacgttgcttgggcaaaaggagcatattctcaggagacggggcccctgcctgccacaccaagcattaggccaccaggaagacccccatctgcaagcaagcctagccttccagggagaaagagtcccacagatttttaacaaaagtaacgatggtttcaccaccaccaggagctatggaacagaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtaccttccttcaaataaagaaatttggtacct

SEQ ID NO: 288850 - DNA, 695 bp, Homo sapiens
gaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaagtacgtgaacatgccacagtttcctggggatcttggtttgcttcaaaagaccaaacctgagattgctgggttcaccctggaatagctcaaacgctgacacttgactctgttctgctcttctcctttcttccaacccatctattccctgagacacattttaataaatgttttcttatgaaagagatcaaactttcataaggagaaagaagagtattcatatag

SEQ ID NO: 288851 - DNA, 993 bp, Homo sapiens
ccccaggcccagctgagtttgccactttctaaatgaggctgtgtgctatgcagtattaagagtttccatccctttgatttttcactgggaaaatctagaaattgtgagctctggggatgaggtgaacttggcatggagctccgccagcccctacaggaggcacgcagatgccagactcggcttcccgtgcctgtgcagacacaaagctgtggttcacggggagctgcttttcacgcgtttgcgccttcaaacgtggagagtgttgttagctcggatttattcattctcgaacaaatatctattaaacatcccccaagctgaggaaactgagattcaaggagttgggagacctcacccacagtcacgtggatcctaactggctgagatgagttttgggctcctgctgggctgttgggacccagaggtcggcgacaaggtcacccaggtctcaggtcggtccctgtacctttatctcatccccctcctctgcattcctgaaacccttcccaggacagctcccctgcccaccccgcccttgacctcaccttttccatgagggactccacagcatggcgggtcacccagcagcggcccccggacacctctccctcctggatgatgtcccctctctggctccaggcctcatactcctcctggctcaagtactctacaggtgacattggacggggccatcatagaccagctgtgtgggggtctgggggagtcccatggtaaacacccctgtccccgtgaaccctgccagcactgggagaagctcttcttaggatgtccactttacaaacctgaccctgcacaccccgctctgtgccctgcacctccatcctgaactatctggacacagcaggtgagtgcctcctgccaccctgccagcaccgagcccctcttccagcccaccccagtggggtccaggcccctccctggagcctcaccttgcgggtcacggtgcactgctgagtcatgtcctggatgagg

SEQ ID NO: 288852 - DNA, 304 bp, Homo sapiens
gttcatgccattctcctgtctcagcctcccgagtagctgggactacaggcgcccaccaccacgcctggctaattttttctgtttttagtagagacagggtttcaccgtgttagccaggatggtcttgatctcctgacctcaggtgatctgcccgcctcggcctcccaaagtgctgggattgtgcctcctgccaccctgccagcaccgagcccctcttccagcccaccccagtggggtccaggcccctccctggagcctcaccttgcgggtcacggtgcactgctgagtcatgtcctggatgagg

SEQ ID NO: 288853 - DNA, 450 bp, Homo sapiens
gtgttggggacggagccgtggatacacccatactcaacaggcagagggaatagatattcgacgggggaccggggtgtcaacagatgtatccgagttcatgcgtggcagggagctggcggcgggacccgtccctccagctggctctccaaccccaagcctgcattacgaccacggcaaaatgccagaagcccagagaagcggggtttttgaagcggatcgtttgttcagcccgagtgcgtggggcaggaacacacctggaggtcattaaagagaagtcttcacggggcactcaaggcacactgcaaaacaactttttatttaaaaggccaataatgagaataatgagttgcacaagaatgaaaaccttatcccttccaaaagatcggcctatacattatgtataaagttagaataattttaaatacaaaatgccaaagaccagcgggtcca

SEQ ID NO: 288854 - DNA, 738 bp, Homo sapiens
gtcagtctcccagtttttcataatgaaaagttgtttcccctgtgtgacctcttcaatattctcctatattcatgacctcctcagattgtcacccaccagcatatgctctgaggcagtttagagcttacatttccatgtataaaaggcgattcattctctcagcaaacttgcagtccttgatgtgccagacatcagtgatgcagagataaagtaagacacagggcctctgcctgctaagcccacccagcttacatccaggagagtcaggtacttatgtacataattctcagagaatgtgcatgaggcgtgggcctgaattggtagcaaggaaaaaacagaggatggaacagggtctggttgggtagaggagaaagcagaattcccggagaggagtgcaggggtgtagctggagacagtgtacttgagaggacatgatgaaagcgtggaggtaccagcttggttgtgtggccaggtgaggggaacaggccagcagggtgaggtcagagattcttgtcaccttcttctgagagctgtgagaacccgttgttgaagattaggcagagaagtgatctggtcacattttcttttaagaatggcatgtagggcaggaatcttgagaggtgggtgctgcagccatccaggtgaaattcaaagggaataagcgtgagtttgttagcaattggtgtgaagagaggggataaaatttgagccatatacagaaagaggtattaatagact

SEQ ID NO: 288855 - DNA, 399 bp, Homo sapiens
ggcttcccaggcctggccagcaagagcacaaacagggagccatggaggactgttgttgccgaatacagacggggtttcaccgtgttagccaggatggtcttgatctcctgacctcgtgatccacccgcctcagcctcccaaagtgttgggattacaggtgtgagccaccgcacccggctacctgtctcctcattcttaaaagatgtaaacccctcccaacactggaagaggaaacagagaccagtgcgctgtgcagtctcacttaactagaatgcacaactcctgcttttatcaccattctgggaaatccccgctgcatttcatggccagggcagcacttcatagttggaaaaggatggtgtggacttgccgcagaggccctagagaaggccatcctgt

SEQ ID NO: 288856 - DNA, 1337 bp, Homo sapiens
ggcttcccaggcctggccagcaagagcacaaacagggagccatggaggactgttgttgccgaatacagacggggtttcaccgtgttagccaggatggtcttgatctcctgacctcgtgatccacccgcctcagcctcccaaagtgttgggattacaggtgtgagccaccgcacccggctacctgtctcctcattcttaaaaggtaaagtttcgatgtagctggaaggggtgtgaggggcattgtcaagtcgctcctgtaaagctgccaaaactccaggattctgcatcacctgatccgtgagcttttccgtcttacttgcatttttagcagcttccacgaaatctgaaggaaccccatctgaaaaactgttatctgccatctgaatgtttttatccccttgtctggtaaaccaagtcccgtgagtaactaggctaaggcactcaggccagtcctcggggagcacacgccgcccatctggctcgcaccgcacagctcccaacagctgagatgcaatgccaaggactttcttccccatcagacatgccctcgtccacacgaaacttacaatcaaaaccccagttagcccagcctgaccccacagatgctcacgatgaccatcgccctacggaaaaactcaaattcctaaacatctaataaagaggtcctggacgtctccaccttaaaaacgggaagcctgaatgctcctccgggtgcgccgcggccctccgggtacgcggggctggctgggctagcgggagatttgagctgccagcccccactcgccgccctctacgcctcctccgctgggccgccggcgaggaagccgcccgcagcgcagaacaaagcgacttgaccttcagggcagtgggcggcagggcaggggcgcaccgggtgctgggaggggccgctccaggccccaagccccaggcccgccgcggcggcgctgcccaccctgacgaggacgtctactttttcttgaaaaatgtctttcctttcccaaaagtgactctgctttgtctgaaaataatataactttaatggctttaagttattgtttgaaagggttcagaaaagacaataaatgggagacttagaatggctcaccagttaaaatccaagtttcatatatttcttgtatttgctaatttcccttatctgtttcagctgcttgttcagaaaaatttcattcatagactcaccttatcccagccctagagactcatattctctatttgccctggaatcctgttcactatttacaattatattattctgaataatagtatttactattttcgtctcttttatattttaataaaccactttcaagtcactg

SEQ ID NO: 288857 - DNA, 801 bp, Homo sapiens
acagaatcctgcaatatgtccttggaaggtctctgctgaaaatttcaatgcctcctgcaaaaagaaggaagagaaagaaaaggagaaaacagaggcagaggatctttccctagaagagattctgtgaaacgctccctcttatggaaacacacataaagtctctctcttgcctgtctcccgttgaagatcaaccagttctcctgccaggtttgaggacccgggctcaggccccggcaggtatccgggatggtccctctccctaacccgggcaaggagcatcggtgaccgctgcaagccctcggcagcatcccagcttggcagcccctccccctggcctccccaacccggcgccctggggaggatggggcacttacaggcggcggctgagaccctccaccgagcgcccgcaggagggcaccgcgtagctcagcaggaacaccgcgacgctccactgctgaaccagtctccgctgcatcgtctccgctcgcgctcgggacctgcaacagaagggaatgggacccgagtgtcagtctggactctccatctccccgcactactccgctccccctttttagcccgctctcaaaaagcctcttcaacatcaagggcatctcccaagttgaaaagaaaaaaaatttctctggagcctctcagcacttacttatttagcaaccggctactccaactgtgctttctccaaaccacacagccagaaagagcaaaaagggaaaaaagaaacaaatcagaggcgcttcctctgaaataatagcgaaaataaaatggttttatatatgcaaaaat

SEQ ID NO: 288858 - DNA, 276 bp, Homo sapiens
ggtacccattacgaaaaatggcaaaggatagtggcagaaattagcaaagtttggggtgatacaagctccagctcccttctctctgagtttagggcagaaggggaggggcatttaagtgactctgaagaggaaatagtggttttttgttctcacaaacaaggtctccaccctgtccctgccttttttcttaccttgccctgaacgcctagagtttctttaagaacaggagagccctggaccactgaggtcctaggagactaactggcaggttggccc

SEQ ID NO: 288859 - DNA, 1561 bp, Homo sapiens
  misc_feature (983)..(983): n is a, c, g, or t
  misc_feature (985)..(986): n is a, c, g, or t
  misc_feature (988)..(988): n is a, c, g, or t
  misc_feature (1007)..(1008): n is a, c, g, or t
gctgcgtgcgcgtctcctccagacagcaaggggaacccgaggccgccggcgcccggaccatgtcgtctccggggccgtcgcagccgccggccgaggacccgccctggcccgcgcgcctcctgcgtgcgcctctggggctgctgcggctggaccccagcgggggcgcgctgctgctatgcggcctcgtagcgctgctgggctggagctggctgcggaggcgccgggcgcggggcatcccgcccgggcccacgccctggcctctggtgggcaacttcggtcacgtgctgctgcctcccttcctccggcggcggagctggctgagcagcaggaccagggccgcagggattgatccctcggtcataggcccgcaggtgctcctggctcacctagcccgcgtgtacggcagcatcttcagcttctttatcggccactacctggtggtggtcctcagcgacttccacagcgtgcgcgaggcgctggtgcagcaggccgaggtcttcagcgaccgcccgcgggtgccgctcatctccatcgtgaccaaggagaaggaactttttcaagagtgaagaataaaaagggaggatgtgaatttatttcaagatgatcatcaaaggatgaaggaacagatgaggtgtgagtggacttcccagatcaagaaatggacagcattatcagcctgaagaaaagaggccactgtgactacagtcaagatgctcagctcagcaagacttgaggacagctcaaaccatctttggctactgtgcccagtagcaaaggagtaaatgtgatactgtccagaaacaagatgtgtaggccataagagaaaagaaattatgttaggaattagaggccaataacattattgaatatttattattttttgaaagaactttgctgctgaagttggtgagaatagcagagaagggtatgtttcataacgcaaagagaggctagaaatagttgacttaatacatttgctgaananntncagaatgtaggaattttannttttatgtttaaatttttcaaaatttcatgattagacaaggtggtcttcttcttaagcccataaaaactacagtaaactagataggccataaagatgctgtgtccatcattctgattgattcttttcctaagcacaaaaagaaaagaaaattacaaaatcagagctaaggctaccaaaggagcgtttcactcttaagtgtgctgatatggtttgaaggtgtccccaaatgtttatgtattagaaacttaatccctaatgcaacagtgtcaagagatgggaacttaaaagatgactaggtcatgagggctctgccttcatcaatggattagtgctgttatcaccagagtgggttagttattgtgggagtgggtttctgagaagaaggatgagtttggccccctttctctctctctctctttcatcctctcttacccttctgccttccaccatgggatgatgcagcatgaaggcccttgccagatgccagtgctatcctcttggacttcccagccttcagaactgtaagaaataaatctctgttctttataaatt

SEQ ID NO: 288860 - DNA, 341 bp, Homo sapiens
cggcacgaggcgatggagcgaaaagtgaggaaactgaagtcccgggagagacagtggcaaggtcaagtagcaaagtgcactcagccctcccagcaaggagtctgccactcgcgcttgaaggacgtgtttgaagagctgctttcccagtgggatgctgccttaaagtcttgattccctggcactctttcctattactacattttatcggtgctgtttgtgttatgcaacggtagcatcgtgtctccggaagataaaaaaggtctcgatacaaacatccataaccttccacccactccgtcaggaacaacccaatcaaaataaagtcatgagaatttagaaag

SEQ ID NO: 288861 - DNA, 388 bp, Homo sapiens
ccccttggctgcaggaattcggcacgaggacctcaccgctgcggggcgatggagcgaaaagtaggaaggaggtgaggaaactgaagtcccgggagagacagtggcaaggtcaagtagcaaagtgcactcagccctcccagcaaggagtctgccactcgcgcttgaaggacgtgtttgaagagctgctttcccagtgggatgctgccttaaagtcttgattccctggcactctttcctattactacattttatcggtgctgtttgtgttatgcaacggtagcatcgtgtctccggaagataaaaaaggtctcgatacaaacatccataaccttccacccactccgtcaggaacaacccaatcaaaataaagtcatgagaatttagaaag

SEQ ID NO: 288862 - DNA, 386 bp, Homo sapiens
gagccgttaaagcctggggctgcgggagaagttgagggattttcgtttataacaactctaccattttgcaggtgaggaaactgaagtcccgggagagacagtggcaaggtcaagtagcaaagtgcactcagccctcccagcaaggagtctgccactcgcgcttgaaggacgtgtttgaagagctgctttcccagtgggatgctgccttaaagtcttgattccctggcactctttcctattactacattttatcggtgctgtttgtgttatgcaacggtagcatcgtgtctccggaagataaaaaaggtctcgatacaaacatccataaccttccacccactccgtcaggaacaacccaatcaaaataaagtcatgagaatttagaa

SEQ ID NO: 288863 - DNA, 533 bp, Homo sapiens
tctggaactcggagatgagcacgtccttgtcggtggtgcccaggcagctgaacttctgcatcagctccgggtccaggtctacgtccatgccctccatggcggggaccggacacccgcttccccgcctcttcacaaccaagccgccgccgcgccgccgggcccggggacctggaggggggccgctgctagctagcttcgcgaccccgctcctttgaggtgaggaaactgaagtcccgggagagacagtggcaaggtcaagtagcaaagtgcactcagccctcccagcaaggagtctgccactcgcgcttgaaggacgtgtttgaagagctgctttcccagtgggatgctgccttaaagtcttgattccctggcactctttcctattactacattttatcggtgctgtttgtgttatgcaacggtagcatcgtgtctccggaagataaaaaaggtctcgatacaaacatccataaccttccacccactccgtcaggaacaacccaatcaaaataaagtcatgagaatttagaaag

SEQ ID NO: 288864 - DNA, 5367 bp, Homo sapiens
  misc_feature (942)..(942): n is a, c, g, or t
gcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctcctcctcctcctcctcctcttccgccaaggcccgcgctgggcccccgggcgcacaccgctcccctgccacttccgcgggacccgagctggccggactcccgaggcgccccccgggagagccgctccngggcttctctaaacttggtgggggcggcctgcggagccccgcagccggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgactcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaatccttattagcttgaatccttattagcttgaatcctccatgcaaatcatggagtctgtgtcccacctgatgtggttgaggagaagccaggtcttcaaagaggggtcagcctggggcaaagcaggactggggggaggtgggcagcagggcctattctgagaatcacatattgttacaggccttgcaccccctttgctgcttccctcctgctcatttggggctgccaccagctctccaccctcctggttccgctggccgggccaagagaggatggagggatgggagtcccaggagatccttgtaaatagtggggtgggactgttctgagtgatcacccgagcacttaaagctccagagtcccattcttcctggatggagcaggtggaggtgcagaggggatttcctcctctccttcctcctgtcgagaattaacacctctccacagccttcccctccagaacaccagccagggaggggtggggaaggaggtcacagccaagaaaactgccctgtgacgacttccctccttcccgcctatgtgagccatcctgagatgtctgtacaatagaaaccaaaccaaatgggcaccctcggttgccggggggcaggtggggaggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagaatatatgtagggagagaagaagaaaaaaatacatttgtattcagagttaaatcttaaaaaaaaaaagtgtttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctcctcccctctccccctccccctcaggggagccggcagagccaaacaaagaaagggattaacaagaaaggaagaagctgtaggactaaggactgaggatcctggggtgtcccccaccactttcccctgccctgtcgcaggggcaagtgaggagggggaatccagaattaaggcctagcaggcctataggaaccctcagagatgtgtgagatttaagagatctagatttttttttaaccaaaaacaagagagaaagagaagaaaaagagaaaccgaggggtttaaaagaaaagaatactacaaaataataattattaataataataattcaaatttatttcatataatcctagagagagaaagaaacaattactagttacttagtagacaatattaagatagcttaaagtttagtagcattgagggcccctgggtccagtagaatgtataaaagttgtaaggaaaagataaatagaggagggaagtggctgagtccaccctgagttgcccaatcttcagataccagggttggatcaggttgctagtttaagattgggagcttccagtctgctggggttgattctgagaatccttggatttttaaattgtaggacaaagaaatgaggggttcatttcccagggtcttggaaaggatgcacactgatcatctcaataagacaggggctgggttgggggcagcagaggaggccaagcacattcacctgcacccctagtacctgggcagcccatactccaatgtggtatgtcccctcctggggctcccagctcaaaccctcccatgcctgcttcccccaggcctaactgaggaagtccttcttgaagtgtgacctcggtccacttctctacagattgatttaagagcctgggaagtcattccacaaacagacacacatgcacacacgcttctcaccttcagagcttcaagagcactgaggcgatcagtcccctacccctgttcccatccagctttccacttagctttgacctccatggcagcagtagcagtaacaatctcagtaattgttctttaaagctgactcgttcttcacctacttgcaaagtgctttcttgtctcataaaagttagattccaagaaggacttcccacggagtggagtggaaacactgtccttgaaggcctgggagaaaggcatccccatgggcacagaggctggggaaaggcacagggactttgggtgaccctaaccctgaccctctgctccagttcacctccatctatatgtgttcaggtaggggtcatctactgtaccctggcctgggaacacattgccctccccacacaaaactggagggcttggcttctgcgtgtgagaaatcaacatttttaaagcacttgccttctaccaaccccagcttgcaatcactgggccttcccctcctatccaaggggttggaggggccccttggctctccttttggcaggaggagcctgcttcattacaccaatgactctgccatccccctccctggccctagaccccaaacacatctccctctacccaatttactcttctcgccccacctagggacagattccccctgctctttttgtcctagaaaccccgctagtttgggatggtagcgtctggggtggggagggcttccccttccccactcgagggtgcgggtggggaagggggggtgggtggagacagccctggggcagggaggatggtctctccactgtagaaagtagagtaggattgtggtcagacttaatttgaggcatctagtgaagacacgtacaaatccaccaaggaaaaagatttcaaaagcaaaataaaagcgggaaataaaacagacccaagaataatcaagtcaaagtgatgttgcacaaaatgcagagaaaccaagaagggggagggttaatgtattaaatgtgctattaagaacttaattttattaaaagtactattacttaa

SEQ ID NO: 288865 - DNA, 327 bp, Homo sapiens
aagtatgcagtactgatttatcagtataaatcgaaagagcttagatctgtaataaaatccaaattggggaagggcaaactttaaaacagcagccagtagagaagggtggggaagggagacttaatttgaggcatctagtgaagacacgtacaaatccaccaaggaaaaagatttcaaaagcaaaataaaagcgggaaataaaacagacccaagaataatcaagtcaaagtgatgttgcacaaaatgcagagaaaccaagaagggggagggttaatgtattaaatgtgctattaagaacttaattttattaaaagtactattacttaa

SEQ ID NO: 288866 - DNA, 5480 bp, Homo sapiens
  misc_feature (1055)..(1055): n is a, c, g, or t
gcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctcctcctcctcctcctcctcttccgccaaggcccgcgctgggcccccgggcgcacaccgctcccctgccacttccgcgggacccgagctggccggactcccgaggcgccccccgggagagccgctccngggcttctctaaacttggtgggggcggcctgcggagccccgcagccggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgactcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaatccttattagcttgaatccttattagcttgaatcctccatgcaaatcatggagtctgtgtcccacctgatgtggttgaggagaagccaggtcttcaaagaggggtcagcctggggcaaagcaggactggggggaggtgggcagcagggcctattctgagaatcacatattgttacaggccttgcaccccctttgctgcttccctcctgctcatttggggctgccaccagctctccaccctcctggttccgctggccgggccaagagaggatggagggatgggagtcccaggagatccttgtaaatagtggggtgggactgttctgagtgatcacccgagcacttaaagctccagagtcccattcttcctggatggagcaggtggaggtgcagaggggatttcctcctctccttcctcctgtcgagaattaacacctctccacagccttcccctccagaacaccagccagggaggggtggggaaggaggtcacagccaagaaaactgccctgtgacgacttccctccttcccgcctatgtgagccatcctgagatgtctgtacaatagaaaccaaaccaaatgggcaccctcggttgccggggggcaggtggggaggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagaatatatgtagggagagaagaagaaaaaaatacatttgtattcagagttaaatcttaaaaaaaaaaagtgtttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctcctcccctctccccctccccctcaggggagccggcagagccaaacaaagaaagggattaacaagaaaggaagaagctgtaggactaaggactgaggatcctggggtgtcccccaccactttcccctgccctgtcgcaggggcaagtgaggagggggaatccagaattaaggcctagcaggcctataggaaccctcagagatgtgtgagatttaagagatctagatttttttttaaccaaaaacaagagagaaagagaagaaaaagagaaaccgaggggtttaaaagaaaagaatactacaaaataataattattaataataataattcaaatttatttcatataatcctagagagagaaagaaacaattactagttacttagtagacaatattaagatagcttaaagtttagtagcattgagggcccctgggtccagtagaatgtataaaagttgtaaggaaaagataaatagaggagggaagtggctgagtccaccctgagttgcccaatcttcagataccagggttggatcaggttgctagtttaagattgggagcttccagtctgctggggttgattctgagaatccttggatttttaaattgtaggacaaagaaatgaggggttcatttcccagggtcttggaaaggatgcacactgatcatctcaataagacaggggctgggttgggggcagcagaggaggccaagcacattcacctgcacccctagtacctgggcagcccatactccaatgtggtatgtcccctcctggggctcccagctcaaaccctcccatgcctgcttcccccaggcctaactgaggaagtccttcttgaagtgtgacctcggtccacttctctacagattgatttaagagcctgggaagtcattccacaaacagacacacatgcacacacgcttctcaccttcagagcttcaagagcactgaggcgatcagtcccctacccctgttcccatccagctttccacttagctttgacctccatggcagcagtagcagtaacaatctcagtaattgttctttaaagctgactcgttcttcacctacttgcaaagtgctttcttgtctcataaaagttagattccaagaaggacttcccacggagtggagtggaaacactgtccttgaaggcctgggagaaaggcatccccatgggcacagaggctggggaaaggcacagggactttgggtgaccctaaccctgaccctctgctccagttcacctccatctatatgtgttcaggtaggggtcatctactgtaccctggcctgggaacacattgccctccccacacaaaactggagggcttggcttctgcgtgtgagaaatcaacatttttaaagcacttgccttctaccaaccccagcttgcaatcactgggccttcccctcctatccaaggggttggaggggccccttggctctccttttggcaggaggagcctgcttcattacaccaatgactctgccatccccctccctggccctagaccccaaacacatctccctctacccaatttactcttctcgccccacctagggacagattccccctgctctttttgtcctagaaaccccgctagtttgggatggtagcgtctggggtggggagggcttccccttccccactcgagggtgcgggtggggaagggggggtgggtggagacagccctggggcagggaggatggtctctccactgtagaaagtagagtaggattgtggtcagacttaatttgaggcatctagtgaagacacgtacaaatccaccaaggaaaaagatttcaaaagcaaaataaaagcgggaaataaaacagacccaagaataatcaagtcaaagtgatgttgcacaaaatgcagagaaaccaagaagggggagggttaatgtattaaatgtgctattaagaacttaattttattaaaagtactattacttaa

SEQ ID NO: 288867 - DNA, 5833 bp, Homo sapiens
  misc_feature (1055)..(1055): n is a, c, g, or t
gcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctcctcctcctcctcctcctcttccgccaaggcccgcgctgggcccccgggcgcacaccgctcccctgccacttccgcgggacccgagctggccggactcccgaggcgccccccgggagagccgctccngggcttctctaaacttggtgggggcggcctgcggagccccgcagccggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgacctcctaacatgaccctttacctcccaccccacccccatatcctgtttgggaaactgtcaccagtttccagcagtgtaagggagttggagtcctatcagaagttgcatagatcttctaggggttggggagagaagcatgtcaatcgtttctgtggctgaaaggctcagaagccatctgtccccacaaagctgggctagaggaatctggagaggagtcctcctctctgcccctgtcccctgcagtgtttcccttcactctctccgcctatcttcccttcctttgggatcttccctttcctcaactctttcctttccctccagctctttgctttgctttcttttggtggctgtcactcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaatccttattagcttgaatccttattagcttgaatcctccatgcaaatcatggagtctgtgtcccacctgatgtggttgaggagaagccaggtcttcaaagaggggtcagcctggggcaaagcaggactggggggaggtgggcagcagggcctattctgagaatcacatattgttacaggccttgcaccccctttgctgcttccctcctgctcatttggggctgccaccagctctccaccctcctggttccgctggccgggccaagagaggatggagggatgggagtcccaggagatccttgtaaatagtggggtgggactgttctgagtgatcacccgagcacttaaagctccagagtcccattcttcctggatggagcaggtggaggtgcagaggggatttcctcctctccttcctcctgtcgagaattaacacctctccacagccttcccctccagaacaccagccagggaggggtggggaaggaggtcacagccaagaaaactgccctgtgacgacttccctccttcccgcctatgtgagccatcctgagatgtctgtacaatagaaaccaaaccaaatgggcaccctcggttgccggggggcaggtggggaggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagaatatatgtagggagagaagaagaaaaaaatacatttgtattcagagttaaatcttaaaaaaaaaaagtgtttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctcctcccctctccccctccccctcaggggagccggcagagccaaacaaagaaagggattaacaagaaaggaagaagctgtaggactaaggactgaggatcctggggtgtcccccaccactttcccctgccctgtcgcaggggcaagtgaggagggggaatccagaattaaggcctagcaggcctataggaaccctcagagatgtgtgagatttaagagatctagatttttttttaaccaaaaacaagagagaaagagaagaaaaagagaaaccgaggggtttaaaagaaaagaatactacaaaataataattattaataataataattcaaatttatttcatataatcctagagagagaaagaaacaattactagttacttagtagacaatattaagatagcttaaagtttagtagcattgagggcccctgggtccagtagaatgtataaaagttgtaaggaaaagataaatagaggagggaagtggctgagtccaccctgagttgcccaatcttcagataccagggttggatcaggttgctagtttaagattgggagcttccagtctgctggggttgattctgagaatccttggatttttaaattgtaggacaaagaaatgaggggttcatttcccagggtcttggaaaggatgcacactgatcatctcaataagacaggggctgggttgggggcagcagaggaggccaagcacattcacctgcacccctagtacctgggcagcccatactccaatgtggtatgtcccctcctggggctcccagctcaaaccctcccatgcctgcttcccccaggcctaactgaggaagtccttcttgaagtgtgacctcggtccacttctctacagattgatttaagagcctgggaagtcattccacaaacagacacacatgcacacacgcttctcaccttcagagcttcaagagcactgaggcgatcagtcccctacccctgttcccatccagctttccacttagctttgacctccatggcagcagtagcagtaacaatctcagtaattgttctttaaagctgactcgttcttcacctacttgcaaagtgctttcttgtctcataaaagttagattccaagaaggacttcccacggagtggagtggaaacactgtccttgaaggcctgggagaaaggcatccccatgggcacagaggctggggaaaggcacagggactttgggtgaccctaaccctgaccctctgctccagttcacctccatctatatgtgttcaggtaggggtcatctactgtaccctggcctgggaacacattgccctccccacacaaaactggagggcttggcttctgcgtgtgagaaatcaacatttttaaagcacttgccttctaccaaccccagcttgcaatcactgggccttcccctcctatccaaggggttggaggggccccttggctctccttttggcaggaggagcctgcttcattacaccaatgactctgccatccccctccctggccctagaccccaaacacatctccctctacccaatttactcttctcgccccacctagggacagattccccctgctctttttgtcctagaaaccccgctagtttgggatggtagcgtctggggtggggagggcttccccttccccactcgagggtgcgggtggggaagggggggtgggtggagacagccctggggcagggaggatggtctctccactgtagaaagtagagtaggattgtggtcagacttaatttgaggcatctagtgaagacacgtacaaatccaccaaggaaaaagatttcaaaagcaaaataaaagcgggaaataaaacagacccaagaataatcaagtcaaagtgatgttgcacaaaatgcagagaaaccaagaagggggagggttaatgtattaaatgtgctattaagaacttaattttattaaaagtactattacttaa

SEQ ID NO: 288868 - DNA, 556 bp, Homo sapiens
ttgagacagagtttcgctcctgttgcccaggctggagtgcaatggtgcgatctcggctcactgcaacctctgcctcccgggttgaagagattctcctgccttatcctccctagtagctgggattacaggtttgctgaaatgaaaatgcgaccttttgcaagggacatgcaagatgaaaccttctatttccttggcagcccagaggaatcatgtgcacgataccttaatttgctgatgtcttttctctgagtggggcatgagcatcagacaagctaatgcaaaagccggaagttctaactggatatactgcctggcgactccgatcaggtcaagatcacctgagactggacatcttcgagagagaacattaattagttaataatctggcagattcactagattatattggcctttctagctttccatagtcatctgcctgtccaagttttcaataattttaaacactaaagtgctggtgcatgacatatgcttaggaatgagtaacacaagtctttgacagcactctacacagaataaaagaatttacccatgggaa

SEQ ID NO: 288869 - DNA, 470 bp, Homo sapiens
ataaaactaatatttataaataaacacaaacacaaaatcttagtttgctgaaatgaaaatgcgaccttttgcaagggacatgcaagatgaaaccttctatttccttggcagcccagaggaatcatgtgcacgataccttaatttgctgatgtcttttctctgagtggggcatgagcatcagacaagctaatgcaaaagccggaagttctaactggatatactgcctggcgactccgatcaggtcaagatcacctgagactggacatcttcgagagagaacattaattagttaataatctggcagattcactagattatattggcctttctagctttccatagtcatctgcctgtccaagttttcaataattttaaacactaaagtgctggtgcatgacatatgcttaggaatgagtaacacaagtctttgacagcactctacacagaataaaagaatttacccatgggaa

SEQ ID NO: 288870 - DNA, 781 bp, Homo sapiens
ttgagacagagtttcgctcctgttgcccaggctggagtgcaatggtgcgatctcggctcactgcaacctctgcctcccgggttgaagagattctcctgccttatcctccctagtagctgggattacaggtttgctgaaatgaaaatgcgaccttttgcaagggacatgcaagatgaaaccttctatttccttggcagcccagaggaatcatgtgcacgataccttaatttgctgatgtcttttctctgagtggggcatgagcatcagacaagctaatgcaaaagccggaagttctaactggatatactgcctggcgactccgatcaggtcaagatcacctgagactggacatcttcgagagagaacattaattagttaataatctggcagattcactagattatattggcctttctagctttccatagtcatctgcctgtccaagttttcaataattttaaacactaaagtgctggtgcatgacatatgcttaggaatgagtaacacaagtctttgacagcactctacacagaataaaagaatttacccatgggaacacggactactgtttgctatcatgattatgtctgaaagcctacagatgcctaaagataggcttctaaattctcagaagactcaaaaccttttttttttttttttttgagaaacagtctagctctgtcacccaggctggagtacgatggcatgatcttagctcactgcaaccaacacctcccgggttcaagtgattctccctcctcagcttcctgagtagctggga

SEQ ID NO: 288871 - DNA, 507 bp, Homo sapiens
ataaaactaatatttataaataaacacaaacacaaaatcttagtttgctgaaatgaaaatgcgaccttttgcaagggacatgcaagatgaaaccttctatttccttggcagcccagaggaatcatgtgcacgataccttaatttgctgatgtcttttctctgagtggggcatgagcatcagacaagctaatgcaaaagccggaagttctaactggatatactgcctggcgactccgatcaggtcaagatcacctgagactggacatcttcgagagagaacattaattagttaataatctggcagattcactagattatattggcctttctagctttccatagtcatctgcctgtccaagttttcaataattttaaacactaaagtgctggtgcatgacatatgcttaggaatgagtaacacaagtctttgacagcactctacacagaataaaagaatttacccatgggaaaaacccaacaaaaaacccgcctccctggcctcaccgc

SEQ ID NO: 288872 - DNA, 655 bp, Homo sapiens
ttgcctcaagacctgaaaatgaatgagcatcatcccttaaagtgttaacacggaagcattaataaaccaagaacaatgagataaatcctgtttgcacatcatttccactgcgtcactcttccttgtctacattctgaagaaatcgcactgaaaacatgtctaaatattcatactctttttgagcttaaatttcagtggccaatttcatactatattggaaagttctgtctaataagagcctgacctgtgtatcctgtatagattttcgccagcagagggtattgtcctgagtgccagcattttgggggatggtgaactgtatcagctgaggagctatagtctatcagttaggagcattattcctttgtcttggatatacttatgttcaaaagcaatttcttctccctcaagaactcattaaatgtattcaccaaattccctaaggttggcatatttcatgttatctggattaaaaatttaggactcagtctcccacatcaattgtctcacataggcagagtaatttttgaaggacggtgaaattaataaataattttagtgaattggggccctaaagtaacaaagaatctggtccatgatgtttaggaatgaaaactataaactactgctggatgaatgacttcacgaatttaaa

SEQ ID NO: 288873 - DNA, 1573 bp, Homo sapiens
tgttttgtttccggtggttgctcctccgggatgtctctttgtgggattgttgttcccaccgtgtctcgttttccccccgggggctttttttatatgtgtgtgggaattcccagtcctcttttttctctgtccccgtttttccctgggtacccctcgtagtgcccctgtttcccttgtgccgctcctggtggcccgcgcggcgctcccacaaccatgtgtttctcttgagagactcttttcgcgggggccgcggggcggccccacacacgtgttgtgttttttttttttttttttttcttctagtctttggtgttcaatattctggtttcaatcatagatgagggaacattaaagttggatgaattctgtgggcttatctactccacactgccttacttcacaaggaggccagtcaggagaaaccaagcactgttttccatacctacacagctccaatgtataagccagtctttaagatattcaaaaaggctatttatgtatgctaatttgacacagggagtgagagtttacaaagagctattaaacacatttgtagccatcaggaactatttctttggatcataaacctgcattgctttcttttccttcccctttgtttcttttcttttcccttttttaaaatttgtttttctccctcccttatttacctatttctgtacttaaagactgtcctggatctgttgcttgattatatatcttaaacacacaaactataaaatggctgtgtatacatgaaactcacagcttgcattataatgcagaggcttaaatttgccatcacatggatgtttttcatatcatactttaaaaaaacacatggatagtttaccctaataaatatttgggggtaccttgagaaatgtaaatggaacagctccatttcaacttctcatataaagagttcagaatattctgtttatgggcttagtagctttgtttaatatagtgattgtgtatttcagaccaagaacaatgagataaatcctgtttgcacatcatttccactgcgtcactcttccttgtctacattctgaagaaatcgcactgaaaacatgtctaaatattcatactctttttgagcttaaatttcagtggccaatttcatactatattggaaagttctgtctaataagagcctgacctgtgtatcctgtatagattttcgccagcagagggtattgtcctgagtgccagcattttgggggatggtgaactgtatcagctgaggagctatagtctatcagttaggagcattattcctttgtcttggatatacttatgttcaaaagcaatttcttctccctcaagaactcattaaatgtattcaccaaattccctaaggttggcatatttcatgttatctggattaaaaatttaggactcagtctcccacatcaattgtctcacataggcagagtaatttttgaaggacggtgaaattaataaataattttagtgaattggggccctaaagtaacaaagaatctggtccatgatgtttaggaatgaaaactataaactactgctggatgaatgacttcacgaatttaaa

SEQ ID NO: 288874 - DNA, 1302 bp, Homo sapiens
gtgatttttctcaggctgttttgtcattttaaaatccagtggtagatgtagcttagcgacggtagttttttgttttggctatactaagacttggaaattattctctccagtgtcagcgaatccagaagggtatcagattaaacaccgaattcagccactggacttttaaaagtacttaagatggtttatctcgggttttttcttcagttaacaaaatcataaatatggtgccttataacatgaaaggaaaattagttgtgtatttcacgacgaaagcgacggaccaaaagaaatttcctgccccaagaagcatgggatccaggaaggggcgcgtagatgcttaacggtctcttcggaaatcctgcaaatagaaagataattctagatccggaatacctgtatctggtggaaaccatggatttctacaagctcgaattattcctcattgtatagcctgctttgtaaactagtttacaatttgcaggctgatcttaagatttttttatatctaattgctgctgccttcattttaggttcagcagttacttttaactaccttaatttattgccagaaggtatgagcctaacattctgatgagtccagaaaactacgttttgtcagtagcaatacactaggaagtaaaatatatttagaatttaaacattgtgtgccagtggtcctcgcgcttgactgcacatcagttacttgaagagccacacctcagatcaatgcagtcagaacctgggaagtaggtcccagacatcaggacctttttaaagctccccaagtgattctacgttccccaagtttgaggaccacttttctgtgcattggcttgcacaatttgaaaataatgcttttcctgagctggatcccagtgttgccttaacagggtgtctgtcgtgccgcagtagagcactgctgcttcctccaaccccaaaatttatgttcctaagtaagtcaggtccctaagccccgtcccaagaagtgacacaagtggccaacatccacactgtaggcttgcaggctacccgccctgagatttggtaaagaacactgccttgttccccatcagtaaacaaggttacctacctcaggaggctgcttgtgagagagcaaatgcagtatcttcagaatgatttatttttttaattaattgtaaagacttgtgccattggctgctctttctagtcccctaaatttctgttctagttttaaatttctctagaacttgcaatagttgggggttttataatgatgttttacaatgtttatttcttaaataaaaacttaaaaattca

SEQ ID NO: 288875 - DNA, 2253 bp, Homo sapiens
gtgatttttctcaggctgttttgtcattttaaaatccagtggtagatgtagcttagcgacggtagttttttgttttggctatactaagacttggaaattattctctccagtgtcagcgaatccagaagggtatcagattaaacaccgaattcagccactggacttttaaaagtacttaagatggtttatctcgggttttttcttcagttaacaaaatcataaatatggtgccttataacatgaaaggaaaattagttgtgtatttcacgacgaaagcgacggaccaaaagaaatttcctgccccaagaagcatgggatccaggaaggggcgcgtagatgcttaacggtctcttcggaaatcctgcaaatagaaagataattctagatccggaatacctgtatctggtggaaaccatggatttctacaagctcgaattattcctcattgtatagcctgctttgtaaactagtttacaatttgcaggctgatcttaagatttttttatatctaattgctgctgccttcattttaggttcagcagttacttttaactaccttaatttattgccagaaggtatgagcctaacattctgatgagtccagaaaactacgttttgtcagtagcaatacactaggaagtaaaatatatttagaatttaaacattgtgtgccagtggtcctcgcgcttgactgcacatcagttacttgaagagccacacctcagatcaatgcagtcagaacctgggaagtaggtcccagacatcaggacctttttaaagctccccaagtgattctacgttccccaagtttgaggaccacttttctgtgcattggcttgcacaatttgaaaataatgcttttcctgagctggatcccagtgttgccttaacagggtgtctgtcgtgccgcagtagagcactgctgcttcctccaaccccaaaatttatgttcctaagtaagtcaggtccctaagccccgtcccaagaagtgacacaagtggccaacatccacactgtaggcttgcaggctacccgccctgagatttggtaaagaacactgccttgttccccatcagtaaacaaggttacctacctcaggaggctgcttgtgagagagcaaatgcagtatcttcagaatgatttatttttttaattaattgtaaagacttgtgccattggctgctctttctagtcccctaaatttctgttctagttttaaatttctctagaacttgcaatagttgggggttttataatgatgttttacaatgtttatttcttaaataaaaacttaaaaattcaacatttctcagctggtggctcacacctgtaatcccagcattttgggaggccaaggcgggaggatcacttgaggccaggagttcaagaccagcctgggcaacacagttaaaccccatcgccacagaaaatcttcaaaaaatttgccagatatggtggcacacaactgtgatcccagctacttggggtggggctgaggtgggaagatcacttgagcccaggaggttgaggctgcagtgaactgtgatcacaccactgcaccacagcctaggcaacagcgagaccttgtctcaaaaattttttctcaaatcaaacatcattgaaaatctactttttataagcttcaaatcacaacatctagtatgtatgctgacagtgatgtttttaaatgccatatatatttaataagtataatgtagaggtttattgtttaaatgaattcactctcaaaatgtgatctgtcaagtccagtagagcttcaaggtaaaatgaaaatttttaaatgtgatctggttatctgcttactgagatactatgtttctaaagttaaagcccaaaataatgaaaatttttccactagaatctcagggaaaaaaagtctaatcttgatatgggtttggtctctggatccggttttagcttcatgaaatttgattacagtttctctctctttaagctataccagttgggggtgagtgaagaaatacccataacctaaagcaatcttgagcctcctaatagcatgtttatggtggagcgctgattaaataagctgtaatttcaaagttaaaaaaaaaatagtctctagattctaacactgaaaagcagtgtatatggctgacattttctcactccacagaaatcaattagcttttgctgttttttacattcatagagaaccagttaaattttcatatcctgttaaactatatcagtatgccttttctaagcaac

SEQ ID NO: 288876 - DNA, 2151 bp, Homo sapiens
gtgatttttctcaggctgttttgtcattttaaaatccagtggtagatgtagcttagcgacggtagttttttgttttggctatactaagacttggaaattattctctccagtgtcagcgaatccagaagggtatcagattaaacaccgaattcagccactggacttttaaaagtacttaagatggtttatctcgggttttttcttcagttaacaaaatcataaatatggtgccttataacatgaaaggaaaattagttgtgtatttcacgacgaaagcgacggaccaaaagaaatttcctgccccaagaagcatgggatccaggaaggggcgcgtagatgcttaacggtctcttcggaaatcctgcaaatagaaagataattctagatccggaatacctgtatctggtggaaaccatggatttctacaagctcgaattattcctcattgtatagcctgctttgtaaactagtttacaatttgcaggctgatcttaagatttttttatatctaattgctgctgccttcattttaggttcagcagttacttttaactaccttaatttattgccagaaggtatgagcctaacattctgatgagtccagaaaactacgttttgtcagtagcaatacactaggaagtaaaatatatttagaatttaaacattgtgtgccagtggtcctcgcgcttgactgcacatcagttacttgaagagccacttttctgtgcattggcttgcacaatttgaaaataatgcttttcctgagctggatcccagtgttgccttaacagggtgtctgtcgtgccgcagtagagcactgctgcttcctccaaccccaaaatttatgttcctaagtaagtcaggtccctaagccccgtcccaagaagtgacacaagtggccaacatccacactgtaggcttgcaggctacccgccctgagatttggtaaagaacactgccttgttccccatcagtaaacaaggttacctacctcaggaggctgcttgtgagagagcaaatgcagtatcttcagaatgatttatttttttaattaattgtaaagacttgtgccattggctgctctttctagtcccctaaatttctgttctagttttaaatttctctagaacttgcaatagttgggggttttataatgatgttttacaatgtttatttcttaaataaaaacttaaaaattcaacatttctcagctggtggctcacacctgtaatcccagcattttgggaggccaaggcgggaggatcacttgaggccaggagttcaagaccagcctgggcaacacagttaaaccccatcgccacagaaaatcttcaaaaaatttgccagatatggtggcacacaactgtgatcccagctacttggggtggggctgaggtgggaagatcacttgagcccaggaggttgaggctgcagtgaactgtgatcacaccactgcaccacagcctaggcaacagcgagaccttgtctcaaaaattttttctcaaatcaaacatcattgaaaatctactttttataagcttcaaatcacaacatctagtatgtatgctgacagtgatgtttttaaatgccatatatatttaataagtataatgtagaggtttattgtttaaatgaattcactctcaaaatgtgatctgtcaagtccagtagagcttcaaggtaaaatgaaaatttttaaatgtgatctggttatctgcttactgagatactatgtttctaaagttaaagcccaaaataatgaaaatttttccactagaatctcagggaaaaaaagtctaatcttgatatgggtttggtctctggatccggttttagcttcatgaaatttgattacagtttctctctctttaagctataccagttgggggtgagtgaagaaatacccataacctaaagcaatcttgagcctcctaatagcatgtttatggtggagcgctgattaaataagctgtaatttcaaagttaaaaaaaaaatagtctctagattctaacactgaaaagcagtgtatatggctgacattttctcactccacagaaatcaattagcttttgctgttttttacattcatagagaaccagttaaattttcatatcctgttaaactatatcagtatgccttttctaagcaac

SEQ ID NO: 288877 - DNA, 866 bp, Homo sapiens
gcgccacaattacttccttgaggctcgctgcaaaagttaatgaagaagaggagtttattccacaagtaaaagacttcacaaagcactatggctctgactattccccgaatgagctgctgaggatggagctggctattctggacagactgcactgggacctctatattgggacgccgctggacttcttgactatagtgagtaaggaggtgtttacagagtctaccctaaactcgtttgtgcctttggaacagctgtttacaacatgggatggcaaagcacaggcgtgcacacgcccttgcacatgcaccacagtgaggtgacgcacaaggctcatgacatacggaagagtgaaaaggtatcttaaatccaacacagttccaccagactcccacttctaaaggacattaaattaactttacaaagatttttagacggcactattatggtgagtttctcttttaaatacacactgcaaaaatatttaactttccattctatgaatactgtacataaatatctgtctgcttttgctacactttacacacattcacttagctgtctttattcacctacacacaatccttattgaagctttagaccatattgatctggcacttaaaaaaatatcatacattagtttgtatttgttttagttgggggaatgatggtcatccttaaggatatgattctgttagtaaggcaaaattatgcaatgtggaaatctcatggggttttggtttgttatgaagcatgaagattaaattactaaagactgtttcattacgaaaactggccaccgttgccaagttgcagagtttcgtcttatgataagcagatacaagtaacttttctgctaccttggtctt

SEQ ID NO: 288878 - DNA, 660 bp, Homo sapiens
gcgccacaattacttccttgaggctcgctgcaaaagttaatgaagaagaggagtttattccacaagtaaaagacttcacaaagcactatggctctgactattccccgaatgagctgctgaggatggagctggctattctggacagactgcactgggacctctatattgggacgccgctggacttcttgactataaatggaaacattgtcatctaggtactttccgctcataacgatgatgtcacaaagcagacttttttttttttttggtcccggagtggaagctcagcttggccacaggatgggcattaagcctcaagccccttacggagccatggataggaatgaaaagggttgggcaacatttgatgttccctgatggaaatttaaattgtttgcacttttgatcattgatataggaaaagtatggcgttttctgttctaacattaaaaaccatggtctccagttccatgccctggtggtcctgagctggccccatgtgttggagctgctgcctcagaggaatccttccctccacgtcgcatccctgaccaggcagctgcagcactgtatggcgggccaccagctgctgcagttcaagggctccacactggccttggtcatcatcaccttagagctggagaggctcatgcccggctg

SEQ ID NO: 288879 - DNA, 740 bp, Homo sapiens
  misc_feature (24)..(24): n is a, c, g, or t
  misc_feature (30)..(30): n is a, c, g, or t
  misc_feature (39)..(39): n is a, c, g, or t
  misc_feature (65)..(65): n is a, c, g, or t
  misc_feature (67)..(68): n is a, c, g, or t
  misc_feature (70)..(70): n is a, c, g, or t
ggcaccatgctgcgggtggaaaanaccccntaccacccnccctacaaaaaacccccccctacaananngnagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtgggcaaggctgaagaaaggggactgggtacttggagactttgcctgggcccctgggaacatgtgttttgtggtgaataaattcacaaggcaagagctggtgtacaggtttaggaaaaaggctctaagcaagttcttacagcacttgtttgtgacattcagtcagataatggccagaagtttttgttaagagccagttcttagaagaacctatgccaaggtcacccatagagtccattggtgtgaaagagaaaggcaaagaggtgtggcgggggagcgtaagatttggagtcagaagtctcagttctgtcatttgtcctggagcaggttattgagtctctttgaatcttggttttcacatctgtaaaatggaaagtcctgcttgtttcatgggatgggtgtgggaataaacaataaatgtcaaacgtgtggcagactcaa

SEQ ID NO: 288880 - DNA, 1180 bp, Homo sapiens
gtgggatttacttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaaactaccaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgccctgaccatgctgtgctggatgagctatttcttacggagactggttggtatcctgtatctgaatgagtctggcaccatgctgcgggtggcccatctgaacttctggggctggcggcaggacacatactgtcccatggcagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtgggcaaggctgaagaaaggggactgggtacttggagactttgcctgggcccctgggaacatgtgttttgtggtgaataaattcacaaggcaagagctggtgtacaggtttaggaaaaaggctctaagcaagttcttacagcacttgtttgtgacattcagtcagataatggccagaagtttttgttaagagccagttcttagaagaacctatgccaaggtcacccatagagtccattggtgtgaaagagaaaggcaaagaggtgtggcgggggagcgtaagatttggagtcagaagtctcagttctgtcatttgtcctggagcaggttattgagtctctttgaatcttggttttcacatctgtaaaatggaaagtcctgcttgtttcatgggatgggtgtgggaataaacaataaatgtcaaacgtgtggcagactcaa

SEQ ID NO: 288881 - DNA, 672 bp, Homo sapiens
  misc_feature (11)..(11): n is a, c, g, or t
gttagaggacnccacgccgaggcacaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgccctgaccatgctgtgctggatgagctatttcttacggagactggttggtatcctgtatctgaatgagtctggcaccatgctgcgggtggcccatctgaacttctggggctggcggcaggacacatactgtcccatggcagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtggactttcggcgtgtgcagactacagatgtttttctttcattgtttgtgtgtgtgtgcgtgtgtgtgcatctgtgtgtggtgactc

SEQ ID NO: 288882 - DNA, 1534 bp, Homo sapiens
gtgggatttacttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaaactaccaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgccctgaccatgctgtgctggatgagctatttcttacggagactggttggtatcctgtatctgaatgagtctggcaccatgctgcgggtggcccatctgaacttctggggctggcggcaggacacatactgtcccatggcagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtgggcaaggctgaagaaaggggactgggtacttggagactttgcctgggcccctgggaacatgtgttttgtggtgaataaattcacaaggcaagagctggtgtacaggtttaggaaaaaggctctaagcaagttcttacagcacttgtttgtgacattcagtcagataatggccagaagtttttgttaagagccagttcttagaagaacctatgccaaggtcacccatagagtccattggtgtgaaagagaaaggcaaagaggtgtggcgggggagcgtaagatttggagtcagaagtctcagttctgtcatttgtcctggagcaggttattgagtctctttgaatcttggttttcacatctgtaaaatggaaagtcctgcttgtttcatgggatgggtgtgggaataaacaataaatgtcaaacgtgtggcagactcaaaaaaaaaaaaaaaaaaaaaaaaaaaaaaaaaagggggggggggccaaaagagaaccccgcgaggggggcccacaggatataagagagagctaaccgaagattgcgggaacacgagggtcggaccacatagagggagaccgataaaagaggcaaagcaccaggccagccgcgttaccacaaccgccgagtaccggggggagaaacgagggcgcacacgggggacccctcagggaggagggcacccctaaacgcgcggggggagggcgcccatcgtggggacagaactggcccaacggaaacataaacaggccccagaggggaaactaagagaaactggaagggagacaaacggga

SEQ ID NO: 288883 - DNA, 837 bp, Homo sapiens
gtgggatttacttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaaactaccaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgccctgaccatgctgtgctggatgagctatttcttacggagactggttggtatcctgtatctgaatgagtctggcaccatgctgcgggtggcccatctgaacttctggggctggcggcaggacacatactgtcccatggcagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtgggcaaggctgaagaaaggggactgggtacttggagactttgcctgggccctctgacatctcggacgaagctagggatacctctagagtcaactac

SEQ ID NO: 288884 - DNA, 721 bp, Homo sapiens
ttgtttcatgggatgggtgtgggaataaacaataaatgtcaaacgtgtggcagactcaacagcctacagcagatattattaagcatttggtcagaggttttagcagggagaaaggcttcgagcagtcagcagggacttccagagccctgtgctgtgcccctcacatatccagcggcagaagggtctgtcaggatgttaactacacattgacgagcagatgtcgtccaggtaggcacgaaaccccagttgagatttgttcaccacccagaggtctagaggctcttgctttggatggccctgcagtgtaataaagccaaatgcaccggatgctggtacgttattttataaacttaagccagttatatacattgccccacataattaataatatatgttcattatacaatttgtaacacagtaaagaggaaggaaggcatgatctttattattttgccactcgaaagtcaataagaatgttttatcgctgggggcggtggctcacacctgtaatcccagcacgttgggaggtcaaggtggcggatcacgaggtcaggagatcgaggccatcctcgctaacagggtgaaaccgtgtctccactaaaaaatacaaaaaaattagctgggcgtggtggcaggtgcctgtagtcccagctactcgggaggctgaggcaggacaatggtgtgaacctgggaggcggagtttgcagtgagccgagatcac

SEQ ID NO: 288885 - DNA, 4361 bp, Homo sapiens
  misc_feature (30)..(30): n is a, c, g, or t
  misc_feature (63)..(63): n is a, c, g, or t
  misc_feature (79)..(79): n is a, c, g, or t
  misc_feature (190)..(190): n is a, c, g, or t
ggtaattttcaacaaacccaggggtaaaangccatcagtcattatggaaatggtcccctggangctacagataaacttnaagtaagtttgcagctttgggtgggacacaaatggcatgtgctgacatcctcatactttattaggggaacatattctggctctgggctgaagccaactcatttcatcatcnatcattgttgtcataatcatcgtcggtcatcatcatagcaaccatttcctgaacgtttattgtgttgcatacactggtccagaaccttaaggcagatgatctatttcatcttctgaagaaatctgagacctgagatgctcccatgagttttgaatatgctctgctccttacagcaaagacaccatttttaaaagtaccattcttttgactttgctgttcccaaggcttctgtgatattccggcccctccgtttaaaagccatcagatttgagagcaataagtcttcaaaaccgggaatttacattgtttttcagctgaccgacttccaggaaaaggactcaaccgcatctacccaaataccgtggcactgcttgcgctctttgccaccggatactccccttccaatgagactttctgattgtgtctaccaactctcctattaggaaacccgtgggttgcatgcagctattctgttgtattctcattctcactctccctcccttctctcactctcactcttgctggaggcgagccactaccattctgctgagaaggaaaagcccgcaactactttaagagattaagacaatatgcgcaatcctcgcctttcctagcaatcactatttaaatctggcaagaactgacaacagtctttgcaagaatggaatccgtaaaacaaaggattttggccccaggaaaagaggggctaaagaattttgctggaaaatcactcggccagatctacagggtgctggagaagaagcaagacaccggggagacaatcgagctgacggaggatgggaagcccctagaggtgcccgagaggaaggcgccgctgtgcgactgcacgtgcttcggcctgccccgccgctacattatcgccatcatgagcggcctgggcttctgcatctccttcggtatccgctgcaacctgggcgtggccattgtggacatggtcaacaacagcaccatccaccgcgggggcaaggtcatcaaggagaaagccaaattcaactgggacccggaaaccgtggggatgatccacggttccttcttttggggctacatcatcactcagattccgggaggctacatcgcgtctcggctggcagccaacagggttttcggagctgccatacttcttacctctaccctaaatatgctaattccatcagcagccagagtgcattatggatgtgtcatctttgtcagaatactgcagggacttgttgagggtgtgacctacccagcatgtcatgggatatggagcaaatgggccccacctctagagaggagtagactggcaaccacctccttttgtggttcctatgccggagctgtgattgcaatgcctttagctggcattcttgtgcagtacactggctggtcttcagtgttttatgtctacggaagctttggaatggtctggtacatgttttggcttttggtgtcttatgaaagtcctgcaaagcatcctactattacagatgaagaacgtaggtacatagaagaaagcattggagagagtgcaaatcttttaggtgcaatggaaaaattcaagactccatggaggaagttttttacatccatgccagtctatgcaataattgttgcaaacttctgcagaagctggactttttatttattgcttattagtcagccagcatattttgaggaagtctttggatttgaaattagcaaggttggtatgctatctgctgtgccacacttagtaatgacaattattgtgcctattgggggacaaattgcagattttctaagaagcaagcagattctttcaactacgacagtgagaaagatcatgaattgtggtggttttggcatggaagccacactgctcctggtcgttggctattctcatactagaggggtagcaatctcattcttggtacttgcagtgggattcagtggatttgctatatctggtttcaatgttaaccacttggatatcgctccaagatatgccagtatcttaatgggcatttcgaatggtgttggcacattgtcaggaatggtttgtcctatcattgttggtgcaatgacaaagaataagtcacgtgaagagtggcagtatgtcttcctgatcgctgccctagtccactatggtggagttatattttatgcaatatttgcctcaggagagaaacaaccctgggcagacccggaggaaacaagtgaagaaaaatgtggatttattcatgaagatgaactcgatgaagaaacaggggacattactcaaaattatataaattatggtaccaccaagtcttatggtgccacaacacaggccaatggaggttggcctagtggttgggaaaagaaagaggaatttgtacaaggagaagtacaagactcacatagctataaggaccgagttgattattcataacaaaactaattactggatttatttttagtgtttgtgattaaattcattgtgattgcacaaaaattttaaaaacacgtgatgtaaacttgcaagcatatcaaccaggcaagtcttgctgtaaaaatgaaaacaaaacaaacccatgaggttaccatcaagtgcaatctgtaaaattgtgaagttccatcatttccattcaagtcatccattcttgcatttgtgacttaaaggttgactggtcaaaattgtagaaacaagtagttacccattggattcatatgagctaaaactcatcactatttactaaagcacaacatctcatcctacaaaagttaagaagccaaagctacttgatcatgcaaaatgcacttatatatttgttacactgtattgcaagatagcacacagaagttggctgcgtcaagtagaggcgacatttattaagtgaaaatcatggagttgggatatctctcaattaaagaaatacattgtgaactatcagctacaaagttgtactgaataactattagaattgcataatgtgagatattttgttagtcctcaaaaggaatatcttgcagtgttttctatgaaatgcttgggcacaaacacttatttctgtgaaagagaacatgtaagttgaggggtatgcttcatgttcttccatccatttacctaatagtatgaaacagttcacatttcaataaaatcaaacttttcatgtagcgtatcacataacttttttgcaaaaaatataaaaagaaataaacttcaatgtattttttattacaactttgtactggttgtaacttgcattagaaaaaaaaaagagatatataaaccacaaagaatctaataagaaatttattatggagatatagcccttaaaatgcaatattaagaacaaagaaatagaaaatggtttagatatctttcttccttcataattaaatactatatgaaacttgtgccacagagctatatgtaatatgaaaagattaacttcatagagatattgtaagtaggtaattttattatttaaagtcctattaagaaatatttgtcttaaatatataggacaatacattatattaaaatggtctctctctatatatatctgtatatcttatacatgtccatacacagaaacataataaacaatcttcacacgaaaccaaaaatagcatacacctaatgttgggttagggaattgcaatttctactttcatagagtcatagaattttaggtggggaagaggcattttgcttgtcatttcttaatataactcaacaagaattgcaacatttgtgtaccaagcaataagtgcaatgcataaaatttcctgtctgtatattaccttcattttgcttgtagtagctgtttgggtggttggaataattttatttttcttttaaaaaagctaacatcagacccctttataatgtcctaaaattatgataatacatttcccaattcaactcaaaatattattggtgtattttgtctattctggatatttgatctgtttaatgtactgtgctagtgactggaggccctgctactgcaaatataaaacctaaagtttgtttaaaaaaatgcaaatcattctttaccttaagaaaaaaaaaataccctttgctttgtgcctcaaagtgatgtaatgtgatcacagcttttgttgtgttgaatgaaaatatgtggactgtcattttgttgcagcaaaaaagtgttaataaaatgctctatttatccttttttta

SEQ ID NO: 288886 - DNA, 822 bp, Homo sapiens
cgagtgtcagtcggctctccgcacgtgtccgcggcctcgcggagcagtccacccctggctggtttctgcttccacctgctgatctcacagagcttgattttgacacaaagcaagatactgaacattaacaccaccacagaggcctactatgtgctcctgtccctgttgttacttcctccaaagtgttggaggaggggccttgtggaaggtgattgaatcacggggacggactttcctgttgctgctcttgtgatggatttctcacaagatctggttgtttgaaagtgtgtagcacctgccacttcactccctctctctcctcctggccatgtgaagactgtgcctgcttcctctttgtcttccaccatgattgtaagtttcctgaggtctccccaggagcagaagcctatacatcctgcagaactgcaagctaattaaatctgttttctttataaattacccagtcccagcactgcaagctatttggcatatgaaggtcttgacctgagaaaaccatcttggataactgcagcaaggaaaaggaaaaatgcaacacctaggagatttcagtaaacagtagaatcatgccaacctaatctgtgttaaaatgcttggaatgtgggagccgctgatgatgcctcttgtctgtgtgtctgactgaatcctttcttttctcagagcagcaaagcaaagcctgggaaccaggccaaatgcctgccacttaccttaaattgatcagccactttgagattaaaacccctgaaagctgccacaccgtgaaaacaaggcctccttcacattaaaggcaaattgcgactttga

SEQ ID NO: 288887 - DNA, 410 bp, Homo sapiens
cccacaaaggctcgcctcatccacttactcatataatcaagaaaattttagactgccgcactgcaagctatttggcatatgaaggtcttgacctgagaaaaccatcttggataactgcagcaaggaaaaggaaaaatgcaacacctaggagatttcagtaaacagtagaatcatgccaacctaatctgtgttaaaatgcttggaatgtgggagccgctgatgatgcctcttgtctgtgtgtctgactgaatcctttcttttctcagagcagcaaagcaaagcctgggaaccaggccaaatgcctgccacttaccttaaattgatcagccactttgagattaaaacccctgaaagctgccacaccgtgaaaacaaggcctccttcacattaaaggcaaattgcgactttga

SEQ ID NO: 288888 - DNA, 588 bp, Homo sapiens
cgagtgtcagtcggctctccgcacgtgtccgcggcctcgcggagcagtccacccctggctggtttctgcttccacctgctgatctcacagagccctagaagtttggaattttattattcgttccagaaaggttacaaaacttgccctagatagctcaaaactggtgaagttgggattctcaagtctcacccctgcatcatatgccattctgcctctccaaggatgtctacacatcacactgcaagctatttggcatatgaaggtcttgacctgagaaaaccatcttggataactgcagcaaggaaaaggaaaaatgcaacacctaggagatttcagtaaacagtagaatcatgccaacctaatctgtgttaaaatgcttggaatgtgggagccgctgatgatgcctcttgtctgtgtgtctgactgaatcctttcttttctcagagcagcaaagcaaagcctgggaaccaggccaaatgcctgccacttaccttaaattgatcagccactttgagattaaaacccctgaaagctgccacaccgtgaaaacaaggcctccttcacattaaaggcaaattgcgactttga

SEQ ID NO: 288889 - DNA, 444 bp, Homo sapiens
cgagtgtcagtcggctctccgcacgtgtccgcggcctcgcggagcagtccacccctggctggtttctgcttccacctgctgatctcacagagcactgcaagctatttggcatatgaaggtcttgacctgagaaaaccatcttggataactgcagcaaggaaaaggaaaaatgcaacacctaggagatttcagtaaacagtagaatcatgccaacctaatctgtgttaaaatgcttggaatgtgggagccgctgatgatgcctcttgtctgtgtgtctgactgaatcctttcttttctcagagcagcaaagcaaagcctgggaaccaggccaaatgcctgccacttaccttaaattgatcagccactttgagattaaaacccctgaaagctgccacaccgtgaaaacaaggcctccttcacattaaaggcaaattgcgactttga

SEQ ID NO: 288890 - DNA, 535 bp, Homo sapiens
cgagtgtcagtcggctctccgcacgtgtccgcggcctcgcggagcagtccacccctggctggtttctgcttccacctgctgatctcacagagcttgattttgacacaaagcaagatactgaacattaacaccaccacagaggcctactatgtgctcctgtccctgttgttacttcctccaaagcactgcaagctatttggcatatgaaggtcttgacctgagaaaaccatcttggataactgcagcaaggaaaaggaaaaatgcaacacctaggagatttcagtaaacagtagaatcatgccaacctaatctgtgttaaaatgcttggaatgtgggagccgctgatgatgcctcttgtctgtgtgtctgactgaatcctttcttttctcagagcagcaaagcaaagcctgggaaccaggccaaatgcctgccacttaccttaaattgatcagccactttgagattaaaacccctgaaagctgccacaccgtgaaaacaaggcctccttcacattaaaggcaaattgcgactttga

SEQ ID NO: 288891 - DNA, 607 bp, Homo sapiens
tagctgggactacaggcgcgcaccaccacacctggctaattttttttttttttttagtagagacggagtttcaccatgtcagccagatggtcttgatctcttgacctcgtgatctgcccacctcggcctccgaaagtgctgggattacaggcatgagccaccgtgcctggccaatttttctatttttagtagaaatggggttttgccatgttggccaggctggtctcgaactcctgacctcaagtgatctgctggcatccaccccacaatgtgctgagattacaagcgtgagccatcgcgcctcgccctgtttcattttataataccattaggcgacctaaaagtagcaaatgtactttccaaaaaattttagctggctttttctttttttatttggtttggattaatataaaaatgttttcattccctgcagatgctgttgactggggcaaagaataatgggagaaaaacagctgggtcctaaataacagagggaaaccaactttcaataaagtattcaacaactaatccacaaagcagataactgaagtaatttagtatatgtaattacatctttttttttttttttttgaggcggattcttgct

SEQ ID NO: 288892 - DNA, 3609 bp, Homo sapiens
ttcaaaaagtaatatgcatctccagcgccactcaaattttgctaaggacagggcagcaaaatcctgccttcaagaaatgtatagactactgcaagaaacaaagaaattaggcaattacaatatagtgtattcaaaagtgttatgctaaaggagctaaagaagacaatgggggtggggagtggataggggtgtctgacacagccgtgcagtcaggaaaagctttccagatgttaaaatttgattcttcagagataggtgttagaccaattaaaataggagaaatgctagggaggatggaggatagaggatctcaatgctactaaagctgaggactagaaaatggtgagtaatgaactgagaggggaagagcaagccagatcacaaataataaaattgtactttattctgagtgcagtggagagacactaaagtaaaaagagagtgacataaccaaatttgtgttttttactgactttattgtcgaatgagtgttaaaattgcaaagaggcgagcatctgaacctgagtactaggttaatcaaatctcaaatccaatccaatactgaaaaggaactagaaatctagagggggaaaagctaaatacaaagcaattccttcaaggcaaaaaccactatcactatcatggggttggggggcaggatacaacagcatctctgagactgtaggattagaattatgtcagaaggaggccaagaagggtctaggatttatctctggaatgacaatgcattatactgatttaagatttgatccttacttacatcctcaattattagaaatataactactagaagttagtctgactatactcctaagaacaaagaaaggcctggtggctcaagcctgtaatcccagcattttggaaggccaaggtgggtggatcacttgaggtcaggagtttaagaccaacctggccaacatgacgaaaccccatctctactaaaaatacaaaaattagccgggtatagtggtgagcacctgtaatcccaactactcaggaggctgaggcacgagaattgcctgaacccgggaagcggaggctgcagtgagccaagactgcaccactgcactccggcgtgggcgcagagccagactctgttgggggtggggtgggggggaaagagaaaaataatacttctaatatgttgcaaacaagacctttaccaatccaagtgttaaaaagaagcctgttgctacagtgccatttacaattaggtttgtttatatgaagcaaattttacatgtggactgggaattagaagactttttgtttcagtctgcctgttttactttgtttttttctgagtctcggctctactgctaactagctatatgattttggctaaggcacttgaaatccatgggccacaagatgatgcaatgggaaatgaatttcatcctttcttacagcctgacaatctgacaatatttgcaacctctatttgtttcaatggcaaactggttgtgacatgatacatgtgcgaaaggtgattttttttgttccaaattagtatccttttaggtaaattctgtattgcccatatgctgtaattgtagttaaaatattagtgttaataaaataaaaaatttaataatgtcacgttagagtggtaagggcttaggggtagttataggtagtattaggagtagttagaaattacttatttttgtaggcttgtttccaagttatcagcagttgaaagggatgtttctacagtacgtggtaaatggcaataaaacaggataaaggaaagatcaaaacaaggctgtggaccaaactataaatccaagagctttgattattatttttttttttttttggagacagtcttactctgtcgcccaggctggagtgcaatggcgcaatctctgctcactgcaagctccgcctcctgggttcaggtcattctcctgcctcagcctcccgagttcccaagtagctgggactacaggcacctaccaccacgcccggccagttttttgtatctttagtacagacagggtttcactgtgttagccaggatggtctccatctcctaacctcgtgatccgcccgcctcagcctcccaaagtgctgggattacaggcgtgagccaccgcgcccagccagctttgactatttttatactcctcacaattctcaagcacttcttaggcagagcacaaaaacaaaaacaaaaaaaaaaacttagaaatatatgaatgcaagagatgggaagaggaaagaccatttcccaactagctcagagtagcctgatcgtaactccaaacagttcacaaaattctcttaggctgaaactattcatctttcctaaatgtccctcatgtctgctaaaatcactttcccaaatgccttgtatctaggaatctgatgcctactgagcttaccttttatcaaattaatagtgactcaatctccattactggaaagcaggcactttaaccttgtagctctaaacagaaatagtttttactgattcagttggaaaacccagcaatttaacaaaaagggggaggggcagcccaatagcatttggaaaatgttaaattttattatttaacattctttaccattatagttactgcacataagactattactactaaaggtcacttcagagtccctgcaaaatggcctggaattttggcagcacccattttacacaatatttctttttccacaaaataacagacataccaggaaaatcatttcagctaaaaatatgagtgaggtggtagaaatatcatcccttataaagcgcaatgttagaatagtacttgagaaagcaggattgttttaagttccaagatttaacaaacttactgttcagcatcatattcaagcctaaaaggaagataggattttcaagatatatttccaacttctttaacatggcaccatggatgaactgtttctcagcactgtgctgcttcacttggaattaaggatgaattgggaggagacagtatgacataggtgggtaggttgggtggtgaggggaaccagttctaatagtcctcaactccactccagctgttcctgttccacacggtccactgagctggcccagtccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatggtgagactccaattcccaggccttaatccttaaccctagacctgttgcctctagcatcatttatttatctacctacctaatagctatctaccagtcactaaaccatggtgagattctaaccatgtctagcacctgatgctagagataattttgttgaatcccttcaattataaacagctgagttagctggacaaggactagggaggcaatcagtattatttattcttgaacaccatcaagtctagacttggtggcttcatatttctatcataatccctgggggtaagaaatcatatagtcccaggttgggaaggggaaaacggtttgcaacattctcctccttg

SEQ ID NO: 288893 - DNA, 2840 bp, Homo sapiens
ttcaaaaagtaatatgcatctccagcgccactcaaattttgctaaggacagggcagcaaaatcctgccttcaagaaatgtatagactactgcaagaaacaaagaaattaggcaattacaatatagtgtattcaaaagtgttatgctaaaggagctaaagaagacaatgggggtggggagtggataggggtgtctgacacagccgtgcagtcaggaaaagctttccagatgttaaaatttgattcttcagagataggtgttagaccaattaaaataggagaaatgctagggaggatggaggatagaggatctcaatgctactaaagctgaggactagaaaatggtgagtaatgaactgagaggggaagagcaagccagatcacaaataataaaattgtactttattctgagtgcagtggagagacactaaagtaaaaagagagtgacataaccaaatttgtgttttttactgactttattgtcgaatgagtgttaaaattgcaaagaggcgagcatctgaacctgagtactaggttaatcaaatctcaaatccaatccaatactgaaaaggaactagaaatctagagggggaaaagctaaatacaaagcaattccttcaaggcaaaaaccactatcactatcatggggttggggggcaggatacaacagcatctctgagactgtaggattagaattatgtcagaaggaggccaagaagggtctaggatttatctctggaatgacaatgcattatactgatttaagatttgatccttacttacatcctcaattattagaaatataactactagaagttagtctgactatactcctaagaacaaagaaaggcctggtggctcaagcctgtaatcccagcattttggaaggccaaggtgggtggatcacttgaggtcaggagtttaagaccaacctggccaacatgacgaaaccccatctctactaaaaatacaaaaattagccgggtatagtggtgagcacctgtaatcccaactactcaggaggctgaggcacgagaattgcctgaacccgggaagcggaggctgcagtgagccaagactgcaccactgcactccggcgtgggcgcagagccagactctgttgggggtggggtgggggggaaagagaaaaataatacttctaatatgttgcaaacaagacctttaccaatccaagtgttaaaaagaagcctgttgctacagtgccatttacaattaggtttgtttatatgaagcaaattttacatgtggactgggaattagaagactttttgtttcagtctgcctgttttactttgtttttttctgagtctcggctctactgctaactagctatatgattttggctaaggcacttgaaatccatgggccacaagatgatgcaatgggaaatgaatttcatcctttcttacagcctgacaatctgacaatatttgcaacctctatttgtttcaatggcaaactggttgtgacatgatacatgtgcgaaaggtgattttttttgttccaaattagtatccttttaggtaaattctgtattgcccatatgctgtaattgtagttaaaatattagtgttaataaaataaaaaatttaataatgtcacgttagagtggtaagggcttaggggtagttataggtagtattaggagtagttagaaattacttatttttgtaggcttgtttccaagttatcagcagttgaaagggatgtttctacagtacgtggtaaatggcaataaaacaggataaaggaaagatcaaaacaaggctgtggaccaaactataaatccaagagctttgattattatttttttttttttttggagacagtcttactctgtcgcccaggctggagtgcaatggcgcaatctctgctcactgcaagctccgcctcctgggttcaggtcattctcctgcctcagcctcccgagttcccaagtagctgggactacaggcacctaccaccacgcccggccagttttttgtatctttagtacagacagggtttcactgtgttagccaggatggtctccatctcctaacctcgtgatccgcccgcctcagcctcccaaagtgctgggattacaggcgtgagccaccgcgcccagccagctttgactatttttatactcctcacaattctcaagcacttcttaggcagagcacaaaaacaaaaacaaaaaaaaaaacttagaaatatatgaatgcaagagatgggaagaggaaagaccatttcccaactagctcagagtagcctgatcgtaactccaaacagttcacaaaattctcttaggctgaaactattcatctttcctaaatgtccctcatgtctgctaaaatcactttcccaaatgccttgtatctaggaatctgatgcctactgagcttaccttttatcaaattaatagtgactcaatctccattactggaaagcaggcactttaaccttgtagctctaaacagaaatagtttttactgattcagttggaaaacccagcaatttaacaaaaagggggaggggcagcccaatagcatttggaaaatgttaaattttattatttaacattctttaccattatagttactgcacataagactattactactaaaggtcacttcagagtccctgcaaaatggcctggaattttggcagcacccattttacacaatatttctttttccacaaaataacagacataccaggaaaatcatttcagctaaaaatatgagtgaggtggtagaaatatcatcccttataaagcgcaatgttagaatagtactttataagggatgatatttctaccacctcactcataaagtac

SEQ ID NO: 288894 - DNA, 2522 bp, Homo sapiens
aaaacaggctcttgctctgtcacagactctgttgggggtggggtgggggggaaagagaaaaataatacttctaatatgttgcaaacaagacctttaccaatccaagtgttaaaaagaagcctgttgctacagtgccatttacaattaggtttgtttatatgaagcaaattttacatgtggactgggaattagaagactttttgtttcagtctgcctgttttactttgtttttttctgagtctcggctctactgctaactagctatatgattttggctaaggcacttgaaatccatgggccacaagatgatgcaatgggaaatgaatttcatcctttcttacagcctgacaatctgacaatatttgcaacctctatttgtttcaatggcaaactggttgtgacatgatacatgtgcgaaaggtgattttttttgttccaaattagtatccttttaggtaaattctgtattgcccatatgctgtaattgtagttaaaatattagtgttaataaaataaaaaatttaataatgtcacgttagagtggtaagggcttaggggtagttataggtagtattaggagtagttagaaattacttatttttgtaggcttgtttccaagttatcagcagttgaaagggatgtttctacagtacgtggtaaatggcaataaaacaggataaaggaaagatcaaaacaaggctgtggaccaaactataaatccaagagctttgattattatttttttttttttttggagacagtcttactctgtcgcccaggctggagtgcaatggcgcaatctctgctcactgcaagctccgcctcctgggttcaggtcattctcctgcctcagcctcccgagttcccaagtagctgggactacaggcacctaccaccacgcccggccagttttttgtatctttagtacagacagggtttcactgtgttagccaggatggtctccatctcctaacctcgtgatccgcccgcctcagcctcccaaagtgctgggattacaggcgtgagccaccgcgcccagccagctttgactatttttatactcctcacaattctcaagcacttcttaggcagagcacaaaaacaaaaacaaaaaaaaaaacttagaaatatatgaatgcaagagatgggaagaggaaagaccatttcccaactagctcagagtagcctgatcgtaactccaaacagttcacaaaattctcttaggctgaaactattcatctttcctaaatgtccctcatgtctgctaaaatcactttcccaaatgccttgtatctaggaatctgatgcctactgagcttaccttttatcaaattaatagtgactcaatctccattactggaaagcaggcactttaaccttgtagctctaaacagaaatagtttttactgattcagttggaaaacccagcaatttaacaaaaagggggaggggcagcccaatagcatttggaaaatgttaaattttattatttaacattctttaccattatagttactgcacataagactattactactaaaggtcacttcagagtccctgcaaaatggcctggaattttggcagcacccattttacacaatatttctttttccacaaaataacagacataccaggaaaatcatttcagctaaaaatatgagtgaggtggtagaaatatcatcccttataaagcgcaatgttagaatagtacttgagaaagcaggattgttttaagttccaagatttaacaaacttactgttcagcatcatattcaagcctaaaaggaagataggattttcaagatatatttccaacttctttaacatggcaccatggatgaactgtttctcagcactgtgctgcttcacttggaattaaggatgaattgggaggagacagtatgacataggtgggtaggttgggtggtgaggggaaccagttctaatagtcctcaactccactccagctgttcctgttccacacggtccactgagctggcccagtccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatggtgagactccaattcccaggccttaatccttaaccctagacctgttgcctctagcatcatttatttatctacctacctaatagctatctaccagtcactaaaccatggtgagattctaaccatgtctagcacctgatgctagagataattttgttgaatcccttcaattataaacagctgagttagctggacaaggactagggaggcaatcagtattatttattcttgaacaccatcaagtctagacttggtggcttcatatttctatcataatccctgggggtaagaaatcatatagtcccaggttgggaaggggaaaacggtttgcaacattctcctccttg

SEQ ID NO: 288895 - DNA, 2384 bp, Homo sapiens
  misc_feature (30)..(30): n is a, c, g, or t
tcgagctcggtaccgggtgtcatgaaacanatttacatgtggactgggaattagaagactttttgtttcagtctgcctgttttactttgtttttttctgagtctcggctctactgctaactagctatatgattttggctaaggcacttgaaatccatgggccacaagatgatgcaatgggaaatgaatttcatcctttcttacagcctgacaatctgacaatatttgcaacctctatttgtttcaatggcaaactggttgtgacatgatacatgtgcgaaaggtgattttttttgttccaaattagtatccttttaggtaaattctgtattgcccatatgctgtaattgtagttaaaatattagtgttaataaaataaaaaatttaataatgtcacgttagagtggtaagggcttaggggtagttataggtagtattaggagtagttagaaattacttatttttgtaggcttgtttccaagttatcagcagttgaaagggatgtttctacagtacgtggtaaatggcaataaaacaggataaaggaaagatcaaaacaaggctgtggaccaaactataaatccaagagctttgattattatttttttttttttttggagacagtcttactctgtcgcccaggctggagtgcaatggcgcaatctctgctcactgcaagctccgcctcctgggttcaggtcattctcctgcctcagcctcccgagttcccaagtagctgggactacaggcacctaccaccacgcccggccagttttttgtatctttagtacagacagggtttcactgtgttagccaggatggtctccatctcctaacctcgtgatccgcccgcctcagcctcccaaagtgctgggattacaggcgtgagccaccgcgcccagccagctttgactatttttatactcctcacaattctcaagcacttcttaggcagagcacaaaaacaaaaacaaaaaaaaaaacttagaaatatatgaatgcaagagatgggaagaggaaagaccatttcccaactagctcagagtagcctgatcgtaactccaaacagttcacaaaattctcttaggctgaaactattcatctttcctaaatgtccctcatgtctgctaaaatcactttcccaaatgccttgtatctaggaatctgatgcctactgagcttaccttttatcaaattaatagtgactcaatctccattactggaaagcaggcactttaaccttgtagctctaaacagaaatagtttttactgattcagttggaaaacccagcaatttaacaaaaagggggaggggcagcccaatagcatttggaaaatgttaaattttattatttaacattctttaccattatagttactgcacataagactattactactaaaggtcacttcagagtccctgcaaaatggcctggaattttggcagcacccattttacacaatatttctttttccacaaaataacagacataccaggaaaatcatttcagctaaaaatatgagtgaggtggtagaaatatcatcccttataaagcgcaatgttagaatagtacttgagaaagcaggattgttttaagttccaagatttaacaaacttactgttcagcatcatattcaagcctaaaaggaagataggattttcaagatatatttccaacttctttaacatggcaccatggatgaactgtttctcagcactgtgctgcttcacttggaattaaggatgaattgggaggagacagtatgacataggtgggtaggttgggtggtgaggggaaccagttctaatagtcctcaactccactccagctgttcctgttccacacggtccactgagctggcccagtccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatggtgagactccaattcccaggccttaatccttaaccctagacctgttgcctctagcatcatttatttatctacctacctaatagctatctaccagtcactaaaccatggtgagattctaaccatgtctagcacctgatgctagagataattttgttgaatcccttcaattataaacagctgagttagctggacaaggactagggaggcaatcagtattatttattcttgaacaccatcaagtctagacttggtggcttcatatttctatcataatccctgggggtaagaaatcatatagtcccaggttgggaaggggaaaacggtttgcaacattctcctccttg

SEQ ID NO: 288896 - DNA, 2395 bp, Homo sapiens
ttcaaaaagtaatatgcatctccagcgccactcaaattttgctaaggacagggcagcaaaatcctgccttcaagaaatgtatagactactgcaagaaacaaagaaattaggcaattacaatatagtgtattcaaaagtgttatgctaaaggagctaaagaagacaatgggggtggggagtggataggggtgtctgacacagccgtgcagtcaggaaaagctttccagatgttaaaatttgattcttcagagataggtgttagaccaattaaaataggagaaatgctagggaggatggaggatagaggatctcaatgctactaaagctgaggactagaaaatggtgagtaatgaactgagaggggaagagcaagccagatcacaaataataaaattgtactttattctgagtgcagtggagagacactaaagtaaaaagagagtgacataaccaaatttgtgttttttactgactttattgtcgaatgagtgttaaaattgcaaagaggcgagcatctgaacctgagtactaggttaatcaaatctcaaatccaatccaatactgaaaaggaactagaaatctagagggggaaaagctaaatacaaagcaattccttcaaggcaaaaaccactatcactatcatggggttggggggcaggatacaacagcatctctgagactgtaggattagaattatgtcagaaggaggccaagaagggtctaggatttatctctggaatgacaatgcattatactgatttaagatttgatccttacttacatcctcaattattagaaatataactactagaagttagtctgactatactcctaagaacaaagaaaggcctggtggctcaagcctgtaatcccagcattttggaaggccaaggcgtgagccaccgcgcccagccagctttgactatttttatactcctcacaattctcaagcacttcttaggcagagcacaaaaacaaaaacaaaaaaaaaaacttagaaatatatgaatgcaagagatgggaagaggaaagaccatttcccaactagctcagagtagcctgatcgtaactccaaacagttcacaaaattctcttaggctgaaactattcatctttcctaaatgtccctcatgtctgctaaaatcactttcccaaatgccttgtatctaggaatctgatgcctactgagcttaccttttatcaaattaatagtgactcaatctccattactggaaagcaggcactttaaccttgtagctctaaacagaaatagtttttactgattcagttggaaaacccagcaatttaacaaaaagggggaggggcagcccaatagcatttggaaaatgttaaattttattatttaacattctttaccattatagttactgcacataagactattactactaaaggtcacttcagagtccctgcaaaatggcctggaattttggcagcacccattttacacaatatttctttttccacaaaataacagacataccaggaaaatcatttcagctaaaaatatgagtgaggtggtagaaatatcatcccttataaagcgcaatgttagaatagtacttgagaaagcaggattgttttaagttccaagatttaacaaacttactgttcagcatcatattcaagcctaaaaggaagataggattttcaagatatatttccaacttctttaacatggcaccatggatgaactgtttctcagcactgtgctgcttcacttggaattaaggatgaattgggaggagacagtatgacataggtgggtaggttgggtggtgaggggaaccagttctaatagtcctcaactccactccagctgttcctgttccacacggtccactgagctggcccagtccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatggtgagactccaattcccaggccttaatccttaaccctagacctgttgcctctagcatcatttatttatctacctacctaatagctatctaccagtcactaaaccatggtgagattctaaccatgtctagcacctgatgctagagataattttgttgaatcccttcaattataaacagctgagttagctggacaaggactagggaggcaatcagtattatttattcttgaacaccatcaagtctagacttggtggcttcatatttctatcataatccctgggggtaagaaatcatatagtcccaggttgggaaggggaaaacggtttgcaacattctcctccttg

SEQ ID NO: 288897 - DNA, 2491 bp, Homo sapiens
ttcttattcttccgccaggctgaagtccaatgcgcaagagcaaagactctgttgggggtggggtgggggggaaagagaaaaataatacttctaatatgttgcaaacaagacctttaccaatccaagtgttaaaaagaagctacatgtggactgggaattagaagactttttgtttcagtctgcctgttttactttgtttttttctgagtctcggctctactgctaactagctatatgattttggctaaggcacttgaaatccatgggccacaagatgatgcaatgggaaatgaatttcatcctttcttacagcctgacaatctgacaatatttgcaacctctatttgtttcaatggcaaactggttgtgacatgatacatgtgcgaaaggtgattttttttgttccaaattagtatccttttaggtaaattctgtattgcccatatgctgtaattgtagttaaaatattagtgttaataaaataaaaaatttaataatgtcacgttagagtggtaagggcttaggggtagttataggtagtattaggagtagttagaaattacttatttttgtaggcttgtttccaagttatcagcagttgaaagggatgtttctacagtacgtggtaaatggcaataaaacaggataaaggaaagatcaaaacaaggctgtggaccaaactataaatccaagagctttgattattatttttttttttttttggagacagtcttactctgtcgcccaggctggagtgcaatggcgcaatctctgctcactgcaagctccgcctcctgggttcaggtcattctcctgcctcagcctcccgagttcccaagtagctgggactacaggcacctaccaccacgcccggccagttttttgtatctttagtacagacagggtttcactgtgttagccaggatggtctccatctcctaacctcgtgatccgcccgcctcagcctcccaaagtgctgggattacaggcgtgagccaccgcgcccagccagctttgactatttttatactcctcacaattctcaagcacttcttaggcagagcacaaaaacaaaaacaaaaaaaaaaacttagaaatatatgaatgcaagagatgggaagaggaaagaccatttcccaactagctcagagtagcctgatcgtaactccaaacagttcacaaaattctcttaggctgaaactattcatctttcctaaatgtccctcatgtctgctaaaatcactttcccaaatgccttgtatctaggaatctgatgcctactgagcttaccttttatcaaattaatagtgactcaatctccattactggaaagcaggcactttaaccttgtagctctaaacagaaatagtttttactgattcagttggaaaacccagcaatttaacaaaaagggggaggggcagcccaatagcatttggaaaatgttaaattttattatttaacattctttaccattatagttactgcacataagactattactactaaaggtcacttcagagtccctgcaaaatggcctggaattttggcagcacccattttacacaatatttctttttccacaaaataacagacataccaggaaaatcatttcagctaaaaatatgagtgaggtggtagaaatatcatcccttataaagcgcaatgttagaatagtacttgagaaagcaggattgttttaagttccaagatttaacaaacttactgttcagcatcatattcaagcctaaaaggaagataggattttcaagatatatttccaacttctttaacatggcaccatggatgaactgtttctcagcactgtgctgcttcacttggaattaaggatgaattgggaggagacagtatgacataggtgggtaggttgggtggtgaggggaaccagttctaatagtcctcaactccactccagctgttcctgttccacacggtccactgagctggcccagtccctttcactcagtgtgtcaccaaaggcagcttcaaggctcaatggcaagagaccacctataacctcttcaccttctgctgcctctttctgctgccactgactgccatggccatctgctatagccgcattgtcctcagtgtgtccaggccccagacaaggaaggggagccatggtgagactccaattcccaggccttaatccttaaccctagacctgttgcctctagcatcatttatttatctacctacctaatagctatctaccagtcactaaaccatggtgagattctaaccatgtctagcacctgatgctagagataattttgttgaatcccttcaattataaacagctgagttagctggacaaggactagggaggcaatcagtattatttattcttgaacaccatcaagtctagacttggtggcttcatatttctatcataatccctgggggtaagaaatcatatagtcccaggttgggaaggggaaaacggtttgcaacattctcctccttg

SEQ ID NO: 288898 - DNA, 2374 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288899 - DNA, 2662 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288900 - DNA, 2206 bp, Homo sapiens
tttttttttttgagatgaagtcttgttctgtcacccaggctggaatgcagtggcgcgatctcggctcactgcatctctgcctcccgggttcaaacaattcttctgcctcagcctcccgagtagctggaactacaggcatgcaccaccatgcctagctaatttttatatttttagtagagacggggtttcaccatattgtccaggctggtctcgaactcctgaccacgtgatccacccaccttggcctcccaaagttctgggattatagacatgagccaccgcgccctgccagggaattgatttttatctgccattgccctctctcagtaggacagttcctttctcttcacctcttctgtcagctaaagaccatgagagggagaaagctagaagctgaagattctgaaaatcactaactggcctcttctttctcctaggtgtggcacattggttgacctttgccagggcccccaccttcggcatactggacagattggaggactgaagctgctatcggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288901 - DNA, 2128 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgatgcccaaatggccggaagctcggggtaccg

SEQ ID NO: 288902 - DNA, 2101 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288903 - DNA, 1249 bp, Homo sapiens
gcggcctggctgattaagtacgagggcggccatatggctctgatgggggacccttgcctttgtcaccactccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288904 - DNA, 897 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcaggtaacaggcccatcctgtaactaccaggattatccttctgcccctttactttctcttcacttgagcaggggaagaaaacttggtctgcttgtttctgttccgtccccattaagatagcctttcctgaagattttgtttttgttttttgttgttgttcttttatacagacggggtctctccatgttgcccaggctagtcttgaactcctgggctcaagcgatccttccatctcagcctcccgaagtgctgggattacaggcatgagccaccaaacccggcctgagatttgttttatctgtattagtttctgcatcagagtctctgtcctttcattggggaaagaaatgaaagcttctgttgctctggtaactcatttcacctttgcaagtttacagttgctgagagatgagcaactttctccccactgtggattgtaaccctgtctgttttaaatcattaatttactttttaataattgatacataataattgaacatatgaatgggtatatgtgatattttgatatatgcatacaatatgtaatgatcaaatcagggtgttcaggatatctgttacccca

SEQ ID NO: 288905 - DNA, 830 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcaggtaacaggcccatcctgtaactaccaggattatccttctgcccctttactttctcttcacttgagcaggggaagaaaacttggtctgcttgtttctgttccgtccccattaagatagcctttcctgaagattttgtttttgttttttgttgttgttcttttatacagacggggtctctccatgttgcccaggctagtcttgaactcctgggctcaagcgatccttccatctcagcacctgtaatcccagcactttggggagggtgaggcaggcggatcacttgaggtcaggagttcgagaccagcctggccaacatggtgaaaccctgtctctactaaaaatacacaaattagctgggtgtgctggcctacgcctgtaatcccagctacaaaaaaggctgaggcaggagagtcacttgaactctgccaggaggcagaggttgcagtgagctgagattgtgccactgcattccagcctgggccacggagcgagacaacatctcaaaaaaaaaaa

SEQ ID NO: 288906 - DNA, 2764 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288907 - DNA, 2518 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288908 - DNA, 2777 bp, Homo sapiens
ttgaaatttaccttcttggctggtgcacatgtagtcccagctacttgggaggctgaggtggaaggatcacttgagcctgggaggttgaggctgtggtgagccatgatcttaaccactgcacccaacttgtgtgacacagcaagacactttctcaaaaaaaaaacaaaaagaaaaagaagaaacaacttactttgttacttgttagctttcataaattcaagttttacttaatcgccctcattactattgttctaactttgtctatccagatttcctgcattcaacttttaacttcatgcatagagctttttctccagctgataatatctgttacctgatatcctatttatattttctctgagtttgtctgtctttgcctataactctagatttctcttgaaggacaggaccttacccgctagccaacaggtgtgtcacccaggtgattgatgcacctcataggatgcaacccaaccaattctcctctttccaggacaatccggggctcagagctgcctgttttggagcggatttgccaggaacttacagctgctgctcgacccttccggaggctagaggcttcacgggatcagcttcgccagttgttcaaggtggggtggagggaagaggtggctcttccaggacatctttgtgggaataaacacttttcttcaatctcccttctacctttttccaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaataaattgggccaggcgcagtggctcatgcctgtaatcccagcactctgggaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288909 - DNA, 2488 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgagtcacttaacttctgagcccatttcctcatttgcaaagtgggaaagaaaatactactcaccctgtccacctcaaagagttgtcgcaaagccaggtttcgttgagggttgagatgactgtggaaactggagagtcccaggcacggtacgatgccacgtgatgaccgcccttatgcaaacacgagtaccgctccctgaagcagccttctgtgttagatagaggtccgcatccctgggagctcatccacgcgcacctctggggaccaacatggcatgcctgtcagtatctttgattgatgatggattagaatgctgtaacccttgatggctactaggacttacg

SEQ ID NO: 288910 - DNA, 1740 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcaggctgaggcggacggatcatgaggtcaggagatcaagaccaccctggctaacacggtgaaaccctgtctctactaaaaatacaaaaaattagccgggcatggtggcacacgcctgtaatcccagctactcaggaggctgaggcaggagaatcgcttgaacccgggaggtggaggttgcagtgagctgagattgcgccactgcacccccctaggcgacagagcgagactctgtctctaaataaataaataaataaataaatacaaactggaaactgctggtcatatg

SEQ ID NO: 288911 - DNA, 680 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggggtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtaagagttgtcaagattaaggcaaacagagaggtggggaagcattgaagaaggcc

SEQ ID NO: 288912 - DNA, 754 bp, Homo sapiens
ttgtgtcattgaatcatctttaaatttatttttatttttttttatatgtcttatcatcttccaaaaaggatgttttggtgaactgcaaagagatatactcagagacaggaaaaagatctggtagggtgaagaatgaaagaaaaacaggcaggcagaataaagctgaaagctgagcctagtatctaaaacgcacactcccagggcttgtatactcaataaagttgagaagtaactgggttgtcaatttaaagaggaatacttgatcagacacacaattctatgttgataagattaaaaacaagctctagtcatccttccgtacctgtaggagattggctgtaggacctttgtggatgccaaactctgcagatactcaagtcccttatgtaaaatggcataagggaccatttgcatgcaacctatgcccctcctcccatatactttaaataatctttagattacctataatacctaatacaatataaaggctatggaaatagttgttatactatattttttcatttgtgtcatttttattgttatttttaattttttagaatatttccaatccatggttgggtgcggaacctgcggatacagaggactgactataatatcaagagatcataaggctgtcggaatggactctttgtggcaataagataccatattataaacaggacccaaggtcatgccaggtaagaatgaagtcacacacccttcctcttaaggaataaactatattgtaactgcc

SEQ ID NO: 288913 - DNA, 724 bp, Homo sapiens
cgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcctgcgaagtttcacaaacaagatttgattgaaaatggcccatggagtacaaccacctgggaacatatcctcgagaaagacagttgaggcttattgcctaaaccacaggctactgaaaacttggccaaaggcgactactctagactggtgacttcaaaagtgctgatgaatacagtgaaccatgaaagatgcattatttgttttgaacattttactatgattgatgacccagatttggcaagttagttcactcccagtggagatgaaagtttcactgccttctttctttcaacattcttgttgagacagatttcacttttattggccaatgtactaacaaatcacttgcatttgcagcataatgaattcattagcaacactgtggatcaatgctatacataatattcctgagtcaacattaactcttaattaaact

SEQ ID NO: 288914 - DNA, 1436 bp, Homo sapiens
cgcgtgtgctttggtggtcttttctgttgactgcatgttgaccagtccctgtttattggtgcggttcttctccatttttgtcgtgtactctggggctggttatgcgtgtgttggtcgtatatgtctgtggttgtgttttttctgctcggcggctgtgcgcgttgtggaactctgcgtgttgctgttcagcctgttattgggctcgtatttcgcctgggtggctgctgcttgtgcctcatctctgtggtgcgtgttatgcgcttgccggatacgccgtcttgttgtgtgttgtgtctatcagcttgatctggttttgcgccgctcccctcgtttgtgctggcgtcttgttgtggtgttctctgcctgctatttcctctttgtggcggccgcggtctagtcgggctgtttctcgtgtcgctgttcttatggcgttctcgacatttgtgtggtgcgtagtggtttgctggcgtggctgtgcctcgctgtttatgtttcctcgtggggcgttgtgttgccgtccccgctttgttggtcggctgtggtttgctgttccgtctcactcgtctgtgctatttagtctgcgtggtactatcgctcggggtggtttcgctggcccacggctctcgggactgccgcgttatgcgcgccctgtggtctgctcgttgtctccgctgcggcttgtccttgcatgtgcgtggtttgcttggcggtgtcctatggtactggtgctgttggatagcgtcttcggtggcctctggtccgttcctcgtgtgtgctgccctctggcagtctctgcgggacccgttggttgctaggcctaggggctctaccgtcacgcgggcatcatgtgctgcgcttgtgtcctcgatcgcgtgtcgcggaacgtgttcccacctctcaccctcgcgtccccttctcgcgtctgttggctgcgctggaggggctgggccgggactcacaacctgtgtcatggtcccctcctcggggacagggtgccgcctgagatactgaagtgcaatgggtctgacctctgacggggcgagagcggcccaagtggttatgctggctctaacaaccctgggccggccaccttcccggagatgacgtcacccccaagagctgcagcaccgcgctgacatcatggcccggccgccccacttctccttgtttatactacacggcgtctttaaaaagctgaatcagaaaccccctttcagcttggggaacagacatgtttatggcaatgtttagaccagcaatgatcgtatcactgtgcaacacaatgactgaagatggaactgagccggctgtcggcagatctctaagcaacacaagagcaaggtcatgatgcagtgctatcgatgctccctggaacgccaaactctatccatcacagttaaaaattacatgtgcatgagaataagtgtggctataca

SEQ ID NO: 288915 - DNA, 1203 bp, Homo sapiens
gggggcgggggaggggggggggtgcctgtctggatcctttaagagctcccgccctgcggaacaatgtgctcccctccccacccccgggtccgggggcagcccggctccttccggggcctctctctttgttgtccgcccgacggcgtctgcctcgcgaggcccacgcgcgatcagtctctctcggcccaggccctcagggagcgggaggcggcgcaggacgcagctgggtctgcgcggcagccggcggctggccctttaagaactgtccgcggcggcagcggaatgtaacaaaccccacatttgattcacaacattcgaagcggcggggtcgcgcgccagacgggagggggctcgcgggggcgcgccgggaggctccggcaaacagtagcccgctgcaagcccgcaggggccccgccccgcgccgggagctccgccctgagagccaatcactcgccgcgaccacgcacgtgactagtgggccgccatcttgaatttttttaacctcctcctcgcccccaccttcgcacttaaagggaccgcagccatagtcaaaagcaaggggcggggccgcatatcctgacataaagatggggagaccccagggtgggcaaaaccgatcggctgcaactcgaacttgctatgcaaactcgctaactactcgcgcctctgaggctcagtttccctgccgaagaaatgggtcccgccaggagaaccggcagtacggacttactgtgtcatggtcccctcctcggggacagggtgccgcctgagatactgaagtgcaatgggtctgacctctgacggggcgagagcggcccaagtggttatgctggctctaacaaccctgggccggccaccttcccggagatgacgtcacccccaagagctgcagcaccgcgctgacatcatggcccggccgccccacttctccttgtttatactacacggcgtctttaaaaagctgaatcagaaaccccctttcagcttggggaacagacatgtttatggcaatgtttagaccagcaatgatcgtatcactgtgcaacacaatgactgaagatggaactgagccggctgtcggcagatctctaagcaacacaagagcaaggtcatgatgcagtgctatcgatgctccctggaacgccaaactctatccatcacagttaaaaattacatgtgcatgagaataagtgtggctataca

SEQ ID NO: 288916 - DNA, 427 bp, Homo sapiens
ttctaacagtatgtatcaggtttctttaattggacatatgccacatctgcatatatttctggaagggtatacaggaaactgattaacaattgttgtccttagggagaactggaagggagaagttgggtcagtaggatagactattgtatatattgcacattagctcttttttaaaaaccctatgcattataacccactgaaatttttaaagaaagctattataaagactatgtcttaagtcttttaagccagaaaaccttttgttcccttagaatcagaaaccccctttcagcttggggaacagacatgtttatggcaatgtttagaccagcaatgatcgtatcactgtgcaacacaatgactgaagatggaactgagccggctgtcggcagatctctaagcaacacaagagcaaggtcatgatgca

SEQ ID NO: 288917 - DNA, 369 bp, Homo sapiens
tctgggtcctgcgggctgcgctagagtgaccctggcacctcgcgtccctcagaactgtgcatccgggctttccgcgtgacacccaggtctccgtacctttgggcacccaccctcgggggcatagtcctgccacctagccctaccctgcagaccgggctctgtccaaggtgctgccggacgggtccggcctacatccggtccttctctgcattccaggcagctccaccaaagtctgcgtgcaacgcccttcatttgcatggacacacgcaaccctcggcgtttgtatggtcattaacatgctcctcccaccacggaagaactttcgaggcccgtaccaaagtagatcctttattcaaaatcaaaaaaaag

SEQ ID NO: 288918 - DNA, 315 bp, Homo sapiens
cctcgagcaggtgcctcccctctccaatgaagcctctcccgtccgcccggcccagaaactgggcaacttactggtttcggcattttcggtttctgggacacactgctgtttgggcaaccctttgtcagggcctgttatctcccacttgcagatccagggcatttcagaggtcagagagaggagggaggcctcttctgagattttgacctctattcaggttctacattcatggaatcagccaaccttggatggaaaagatttggaaaataataaaaataatactacaattaaaataccaataaaaatccaatacag

SEQ ID NO: 288919 - DNA, 2452 bp, Homo sapiens
cagaagaagtggctggaccaggagatggagaaggtgctacagcagcggcgggcgctggaggagctgggggaggagctccacaagcgggaggccatcctggccaagaaggaggccctgatgcaggagaagacggggctggagagcaagcgcctgagatccagccaggccctcaacgaggacatcgtgcgagtgtccagccggctggagcacctggagaaggagctgtccgagaagagcgggcagctgcggcagggcagcgcccagagccagcagcagatccgcggggagatcgacagcctgcgccaggagaaggactcgctgctcaagcagcgcctggagatcgacggcaagctgaggcaggggagtctgctgtcccccgaggaggagcggacgctgttccagttggatgaggccatcgaggccctggatgctgccattgagtataagaatgaggccatcacatgccgccagcgggtgcttcgggcctcagcctcgttgctgtcccagtgcgagatgaacctcatggccaagctcagctacctctcatcctcagagaccagagccctcctctgcaagtattttgacaaggtggtgacgctccgagaggagcagcaccagcagcagattgccttctcggaactggagatgcagctggaggagcagcagaggctggtgtactggctggaggtggccctggagcggcagcgcctggagatggaccgccagctgaccctgcagcagaaggagcacgagcagaacatgcagctgctcctgcagcagagtcgagaccacctcggtgaagggttagcagacagcaggaggcagtatgaggcccggattcaagctctggagaaggaactgggccgttacatgtggataaaccaggaactgaaacagaagctcggcggtgtgaacgctgtaggccacagcaggggtggggagaagaggagcctgtgctcggagggcagacaggctcctggaaatgaagatgagctccacctggcacccgagcttctctggctgtcccccctcactgagggggccccccgcacccgggaggagacgcgggacttggtccacgctccgttacccttgacctggaaacgctcgagcctgtgtggtgaggagcaggggtcccccgaggaactgaggcagcgggaggcggctgagcccctggtggggcgggtgcttcctgtgggtgaggcaggcctgccctggaactttgggcctttgtccaagccccggcgggaactgcgacgagccagcccggggatgattgatgtccggaaaaaccccctgtaagccctcggggcagaccctgccttggagggagactccgagcctgctgaaaggggcagctgcctgttttgcttctgtgaagggcagtccttaccgcacaccctaaatccaggccctcatctgtaccctcactgggatcaacaaatttgggccatggcccaaaagaactggaccctcatttaacaaaataatatgcaaattcccaccacttacttccatgaagctgtggtacccaattgccgccttgtgtcttgctcgaatctcaggacaattctggtttcaggcgtaaatggatgtgcttgtagttcaggggtttggccaagaatcatcacgaaagggtcggtggtaaccaggttgtggtttaaatggtcttatgtatataggggaaactgggagactttaggatcttaaaaaaccatttaataaaaaaaaatctttgaagggacaaatgggaagttttcacttagagtttgatttacaagacaataggaggaatcagatttgggaacacaacaggcttgaacactttctggagactgagagacagttcagagtcagccctcaccgttagccagacccctggccaggacccgcagcaggctggtccagcgggtctgtggggcactcctgtggggcactcttggtggaaacgatgagccaggtgatggtctccccaggagtgggcaatgggtgaggcctgagccctgaactggctggcttttggacagtccttgaaaatgtggctgctccagaagccactcaagctggaccatggtcacagttaacctcaggcccaacattaaacaaaaatgtactgagtgctcagtcactagagatgattttactgttacacagggaaggcaaaaaatagcttccactgcccaatgcactcttcagtttcacgtatatggcttcacagtttacaaagcgctgcctgtgtcgcagcagcccagccttacagcagctcaagggaccccagggagggcgcctttctccatttgcataaatgaggcagagtggccccctgacttgccaaggtcatggttggggtgaggctggaatgggattccttgtctgggttcctgactcccaggctgcctgagttatagcaccaatcacattgccatccacctctcctcctgcaacttcccca

SEQ ID NO: 288920 - DNA, 1694 bp, Homo sapiens
gcgctctgaagtcagacctgttccctttctttggggaaagcttagagaccactctccctccagcctttattggctcaattcacaggttgcttattgtgctggggcactggggagctagggcttcgggaaggtgttgccacctgtttctgatgaggacacgttactctccatgacaggtggggagaagaggagcctgtgctcggagggcagacaggctcctggaaatgaagatgagctccacctggcacccgagcttctctggctgtcccccctcactgagggggccccccgcacccgggaggagacgcgggacttggtccacgctccgttacccttgacctggaaacgctcgagcctgtgtggtgaggagcaggggtcccccgaggaactgaggcagcgggaggcggctgagcccctggtggggcgggtgcttcctgtgggtgaggcaggcctgccctggaactttgggcctttgtccaagccccggcgggaactgcgacgagccagcccggggatgattgatgtccggaaaaaccccctgtaagccctcggggcagaccctgccttggagggagactccgagcctgctgaaaggggcagctgcctgttttgcttctgtgaagggcagtccttaccgcacaccctaaatccaggccctcatctgtaccctcactgggatcaacaaatttgggccatggcccaaaagaactggaccctcatttaacaaaataatatgcaaattcccaccacttacttccatgaagctgtggtacccaattgccgccttgtgtcttgctcgaatctcaggacaattctggtttcaggcgtaaatggatgtgcttgtagttcaggggtttggccaagaatcatcacgaaagggtcggtggtaaccaggttgtggtttaaatggtcttatgtatataggggaaactgggagactttaggatcttaaaaaaccatttaataaaaaaaaatctttgaagggacaaatgggaagttttcacttagagtttgatttacaagacaataggaggaatcagatttgggaacacaacaggcttgaacactttctggagactgagagacagttcagagtcagccctcaccgttagccagacccctggccaggacccgcagcaggctggtccagcgggtctgtggggcactcctgtggggcactcttggtggaaacgatgagccaggtgatggtctccccaggagtgggcaatgggtgaggcctgagccctgaactggctggcttttggacagtccttgaaaatgtggctgctccagaagccactcaagctggaccatggtcacagttaacctcaggcccaacattaaacaaaaatgtactgagtgctcagtcactagagatgattttactgttacacagggaaggcaaaaaatagcttccactgcccaatgcactcttcagtttcacgtatatggcttcacagtttacaaagcgctgcctgtgtcgcagcagcccagccttacagcagctcaagggaccccagggagggcgcctttctccatttgcataaatgaggcagagtggccccctgacttgccaaggtcatggttggggtgaggctggaatgggattccttgtctgggttcctgactcccaggctgcctgagttatagcaccaatcacattgccatccacctctcctcctgcaacttcccca

SEQ ID NO: 288921 - DNA, 1676 bp, Homo sapiens
cagaagaagtggctggaccaggagatggagaaggtgctacagcagcggcgggcgctggaggagctgggggaggagctccacaagcgggaggccatcctggccaagaaggaggccctgatgcaggagaagacggggctggagagcaagcgcctgagatccagccaggccctcaacgaggacatcgtgcgagtgtccagccggctggagcacctggagaaggagctgtccgagaagagcgggcagctgcggcagggcagcgcccagagccagcagcagatccgcggggagatcgacagcctgcgccaggagaaggactcgctgctcaagcagcgcctggagatcgacggcaagctgaggcaggggagtctgctgtcccccgaggaggagcggacgctgttccagttggatgaggccatcgaggccctggatgctgccattgagtataagaatgaggccatcacatgccgccagcgggtgcttcgggcctcagcctcgttgctgtcccagtgcgagatgaacctcatggccaagctcagctacctctcatcctcagagaccagagccctcctctgcaagtattttgacaaggtggtgacgctccgagaggagcagcaccagcagcagattgccttctcggaactggagatgcagctggaggagcagcagaggctggtgtactggctggaggtggccctggagcggcagcgcctggagatggaccgccagctgaccctgcagcagaaggagcacgagcagaacatgcagctgctcctgcagcagagtcgagaccacctcggtgaagggttagcagacagcaggaggcagtatgaggcccggattcaagctctggagaaggaactgggccgttacatgtggataaaccaggaactgaaacagaagctcggcggtgtgaacgctgtaggccacagcaggggtggggagaagaggagcctgtgctcggagggcagacaggctcctggaaatgaagatgagctccacctggcacccgagcttctctggctgtcccccctcactgagggggccccccgcacccgggaggagacgcgggacttggtccacgctccgttacccttgacctggaaacgctcgagcctgtgtggggactcttcaacaacaccaatatcaggaccaggatcagaggacctcgaggaaccacatgcacaaggattactccataccacttgtaattaacacttattaaggagacaggcagcttctcacttaacaagatcacaaagatcacagggtctgataacaccagtgctgctattctgaaatgtggtacctttgttcttcttgaagttgtcaagtttatcctctagaccatccacagctgacacagaatggcttctaggcaacccccgctttagtgatctctttgaaggggaaagcaattcctggttgaaaagatttcttcgaactttggtcacttctgaaagcatcaaaaattaaaagaaaaagaaaaacccaaagattatcatcaataaatgccgtatctgagaaaagataaccaaaacagagaagctccttgaggaaactacagattgctattgtcacatatgctaataaggtttccttaaatagcatattcccataatgcattaaaaatatttacttttgcaaattaaaaaaaattttatatgttattttgcatg

SEQ ID NO: 288922 - DNA, 859 bp, Homo sapiens
ttttttggtcaggtcctacagcagtggttctcaaaatatttatttttcaacatttaggcccctttgataggcatggcaaaaagcccccaaaagtacctctctgctgctttcttcataccaatagagaaacagtctgcccatgttatcatttctgtactgctgtaacccacagcgtggaatagactttacattcatgctttgtgagactgccttcctgacccgcttgtaggctgcttttgagaaccactaccccagacaacagggcatgtgtgtttaactggaaaatgtggaacacagtgctgagtacagatggcacttcctaagaaatgatggaaacgtctcccttgcactccccactgatgcaggtttgcctcccttctcctccagttgcaggctcctttagctgcaccatgaagtttacagtccgggactgtgaccctaacactggagttccagatgaggatgggtatgatgatgagtatgtggtgagtcttcccagcatagagactttctttgacaccttcacaacactaagtgacttctgccttgagagaacatttttctaggagcatctgacataaacttaagggatttctattcttctgaaacagatgacaaattaggaggacctggactaaccctcctctgtaactggacagcaccaggccagagagaattgagatttaccacttcatcattaaaacaaactcacccttttttttctttataatagggataattaagagatgaaaataatgacatgattttcattgagatcagttttatttaaaatgatttggggagggggttggttttgttttttggttttttgtttttgcttcagcagctgttagtttat

SEQ ID NO: 288923 - DNA, 469 bp, Homo sapiens
ctcttagtgaatgatcagagggtaccgtgtgcccagaactcagtggtcaagtgtgggtgcaacatgactactccttgctttcctttgctaagggctacaacattagatttatccagactacagaacttaaactattttggtggtagagttttctctaggctccggaggaccatattgactagttcctttatctttgccctataacagaaaggacttttctttactgactgcttattacccactagctggaagatctcgaagtgactgtgtctgaccatattcagaaagtactgaagcctaactttgctgctgcttgggaagaggtgggagatacctttgagaaagaggaaacctttgccctcagttctaccaaaacccttgaaggtgagacccattttgctatcagtatattgcctgataacagtataacacctaacaggcatatttgttactccagaagaactccttt

SEQ ID NO: 288924 - DNA, 2373 bp, Homo sapiens
gaagaacaggaagagagcattgtgcatttattaaaacaacatataacacaaactcagttaccaccccgtatgtctgggataggcactgaaatacagcacatcgtccctgtgagtgctaccccatcctcctgctcaggaaaggaagtgggcagctgtatcaacctggcttccttcccctctttctgacaatcgcaggtcacccaacgaccaggcattattatacaaaagttcctttacaaaaagcaccaaattggcatacatatacaagtatatacaaaaatcacattttaaaaatgtacaaaatattccattttgcaccaatgtagaaaagtgtcctgtgtgattgtttcaagcacgtttccaattctggttcagtgtctgctggacgcagcggtgagggtcctaccctagtccctgctctctgagcagagagaagacatcacctccccattgcccctccaggggccccgacccctcccaccctgggcctgtcaccaaggccgctgggcccctccccaccctctccagtctctctgcatctgggggcctctcattcatccagctccttactggtgtccttcttccttcccttctgtggactcttcctcttcctgatcttcttcttcaatgaattcttcctcttcctcatctgtcccaaagtcaatggctctcagggcgtctgctatgtgctctaaatccaaagtaaagaagtccatgttctcaaagccctgctctgtcttccccagctggcagcccttggaagcttccacaatgcttttgatgagttgcttggcagtcaagaggaaggtggctcccccaggctcgtccagggactggatggcagtttccaccagctttgtggacttgtccagctgctcctggtactgctggatgagggcctcgatgaagctaagcttttcctcctgctcctgcgtgatccgctgcagcaactcacttttcttctcatccaggatggcatacaacgtgtcaaacttctggctcagctcttcctttacctggtgactgttctccttggtcactcgacgggaatcctccagctgagtgatgatggtctgcacacggtcattccccgccaccagcatggagatacagttattcagttcagtcttttgtccctggaagacactctgcaatggggccacctcgcaggccttgtggatcccaaacaccttgcacatggagcaggtgggcacctcacacgtgagacagtagatgttgattttctcatcttcgtgctccttgcacatggggtgactgcccttctgcagcggccgactggagcactcctgtttgtagatgtcgatgatgttctccaccagcaggttcctctgcaggccgtacactccgtgacgatccatgatcacctcgtggcggcaggtggggcagcggaaacggcctccagacatggacactgagctgccccggctggtccagtagggatttgcagcctggaagatgtcattggcacacttccggcacaggttgtgctggcacggcaagatgaccactggcttggtaaacatctccaggcagatagggcagatcagctgcttctccaagttctccatgggattcccatcctggatcaggctcgacttataatccattctgtgggaaggaatgagagccacgcctagctgcctcctctactaactttgctctaagtagacctgggggtcttgcctttgtcacaaaacaccgggtcggatcctgttggcttccttctcctggtgcccgaattctaacactcacaacaaaactaactaatactaacatctcagacgctcaggaaatggaaaccgtctgaactatcctgcccgccatcatcctagtcctcatcgccctcccatccctacgcatcctttacataacagacgaggtcagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagca

SEQ ID NO: 288925 - DNA, 2659 bp, Homo sapiens
gaagaacaggaagagagcattgtgcatttattaaaacaacatataacacaaactcagttaccaccccgtatgtctgggataggcactgaaatacagcacatcgtccctgtgagtgctaccccatcctcctgctcaggaaaggaagtgggcagctgtatcaacctggcttccttcccctctttctgacaatcgcaggtcacccaacgaccaggcattattatacaaaagttcctttacaaaaagcaccaaattggcatacatatacaagtatatacaaaaatcacattttaaaaatgtacaaaatattccattttgcaccaatgtagaaaagtgtcctgtgtgattgtttcaagcacgtttccaattctggttcagtgtctgctggacgcagcggtgagggtcctaccctagtccctgctctctgagcagagagaagacatcacctccccattgcccctccaggggccccgacccctcccaccctgggcctgtcaccaaggccgctgggcccctccccaccctctccagtctctctgcatctgggggcctctcattcatccagctccttactggtgtccttcttccttcccttctgtggactcttcctcttcctgatcttcttcttcaatgaattcttcctcttcctcatctgtcccaaagtcaatggctctcagggcgtctgctatgtgctctaaatccaaagtaaagaagtccatgttctcaaagccctgctctgtcttccccagctggcagcccttggaagcttccacaatgcttttgatgagttgcttggcagtcaagaggaaggtggctcccccaggctcgtccagggactggatggcagtttccaccagctttgtggacttgtccagctgctcctggtactgctggatgagggcctcgatgaagctaagcttttcctcctgctcctgcgtgatccgctgcagcaactcacttttcttctcatccaggatggcatacaacgtgtcaaacttctggctcagctcttcctttacctggtgactgttctccttggtcactcgacgggaatcctccagctgagtgatgatggtctgcacacggtcattccccgccaccagcatggagatacagttattcagttcagtcttttgtccctggaagacactctgcaatggggccacctcgcaggccttgtggatcccaaacaccttgcacatggagcaggtgggcacctcacacgtgagacagtagatgttgattttctcatcttcgtgctccttgcacatggggtgactgcccttctgcagcggccgactggagcactcctgtttgtagatgtcgatgatgttctccaccagcaggttcctctgcaggccgtacactccgtgacgatccatgatcacctcgtggcggcaggtggggcagcggaaacggcctccagacatggacactgagctgccccggctggtccagtagggatttgcagcctggaagatgtcattggcacacttccggcacaggttgtgctggcacggcaagatgaccactggcttggtaaacatctccaggcagatagggcagatcagctgcttctccaagttctccatgggattcccatcctggatcaggctcgacttataatccattctgtgggaaggaatgagagccacgcctagctgcctcctctactaactttgctctaagtagacctgggggtcttgcctttgtcacaaaacaccgggtcggatcctgttggcttccttctcctggtgcccgaattctaacactcacaacaaaactaactaatactaacatctcagacgctcaggaaatggaaaccgtctgaactatcctgcccgccatcatcctagtcctcatcgccctcccatccctacgcatcctttacataacagacgaggtcagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttcaa

SEQ ID NO: 288926 - DNA, 1004 bp, Homo sapiens
ttttttggtcaggtcctacagcagtggttctcaaaatatttatttttcaacatttaggcccctttgataggcatggcaaaaagcccccaaaagtacctctctgctgctttcttcataccaatagagaaacagtctgcccatgttatcatttctgtactgctgtaacccacagcgtggaatagactttacattcatgctttgtgagactgccttcctgacccgcttgtaggctgcttttgagaaccactaccccagacaacagggcatgtgtgtttaactggaaaatgtggaacacagtgctgagtacagatggcacttcctaagaaatgatggaaacgtctcccttgcactccccactgatgcaggtttgcctcccttctcctccagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagca

SEQ ID NO: 288927 - DNA, 764 bp, Homo sapiens
ctcttagtgaatgatcagagggtaccgtgtgcccagaactcagtggtcaagtgtgggtgcaacatgactactccttgctttcctttgctaagggctacaacattagatttatccagactacagaacttaaactattttggtggtagagttttctctaggctccggaggaccatattgactagttcctttatctttgccctataacagaaaggacttttctttactgactgcttattacccactagctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagca

SEQ ID NO: 288928 - DNA, 2445 bp, Homo sapiens
tagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacagtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccaagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttcaa

SEQ ID NO: 288929 - DNA, 2159 bp, Homo sapiens
tagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacagtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccaagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagca

SEQ ID NO: 288930 - DNA, 527 bp, Homo sapiens
agccagcacggcactggagactcccgtgagcatgttcactgctgcgatgaccccaattaacagtttaatgggggaaatgtacagaggggatctgaaaactgttgaagtcaccaaagcattacaagatgccaagagataatggtcaaaaacagcctaataacacacagtgcccatgtgcatgctccactatctcaagccactgtcaccctggatcttttgcagcactggctggaatcagtggtggatactgccgttgaggaatttttgatgcctttctcacctggggaaggtgaaccctgcactgaatgaagggctttcaggtcttcctcaaagtcaagcaggaaatcttcaaggtcacgttcatctgcagcccaagaagtcctggaatgattagttctgactctcttttcaagggaccaaatcccagagtggagagtcctgggttattctggagacatgaactgtcacaaattccttgtgctctagctttcttgcaagttattataaagttgcctttggatgtttga

SEQ ID NO: 288931 - DNA, 3155 bp, Homo sapiens
  misc_feature (151)..(151): n is a, c, g, or t
  misc_feature (651)..(651): n is a, c, g, or t
  misc_feature (756)..(756): n is a, c, g, or t
  misc_feature (1003)..(1003): n is a, c, g, or t
  misc_feature (1769)..(1769): n is a, c, g, or t
  misc_feature (2124)..(2124): n is a, c, g, or t
gatttatatttatatatatatatgctgttaaatacagatatatattagatgacattgttaggtacattcaagcttagaattctatcttcctgttttttaaattttttaaaagtggatccatttatcatgaatgccctcctttttcttaacnataaagtatcacttagagtaccttttgtcaaaaaagaaccacttttctttttaaagtattttcttagtattgtaaaaccttttcattttgaacttttctgtacccttatgttgggggaatgtctcttttttggggaagatagattatgtctcttaaaacaacatataattggatattaaaaaaatccattctggcaagctgtcctttagccagtaagtttagtcctcttacatttactctaattactaatatctaacatactattctgagatttgtttatctgctttattcattcttttcccccttccttctcatcttcctttaggttgagacaaacagggtgaatgttcactcttacatttttaacacgcttacttaaagtctagttgagtggttggcaaactacagcccaaaggccaaatccatcctgccgccttgtacagccagagagccaagactagcttttacatttataaatggttgaaaaaaaaaccaaaatnttattttgatacgtgaaaagcatatgaaatttaaatctttcctttagtgtaaaatcaaggggcaaaaagatctatttatagatctatttacagatcatgaaattngaatttcatgatctataaataaagtttaactggaacacagcggttcatgatgtaaaaaaactaatttgtttacatacgttctatggctgtttttgcattaaaatagcaaaatctgccgggcatggtggctcatgcctgtaatcctagcaggttgggaggccaaggtgggaggattgcttgaacccaggagtttcagaccaccttggcaacacagtgagaccctgtctttaaaaaataaaaaaaaaantttaattagctgggtgtggtggctcaagcctgtagttccagctactcgggaggctgaggtgaaaggatcacttgagcctgggaggtcaaggctgcagtaagctgatatcacgccaggctggagtgcagtggcgcgatctcggctcactgcaacctccgcctcctgggttcaagcgattgtcctgcctcagcctcgagtagctgggactacaggcgcatgccaccacacccggctaatttttgtatttttagtagagatggggcttcaccatgttggccaggctggtcttgaactcctgacctcaggtgatccacctgcctcggcctcccaaagtgctgggttaacaggcatgagccaccgtgcctggccctctccttatttaatatatcatatatagcatctctgctttgtcctatttatcaaaaaacattatttttcctttgttaggtcctcgatcttatcatctaaccatttttaaactacaaatttgtattttagaaatatttggtctagcaaaatggctccgaagcaaaaatcaggactcttttgcttcagaataacaaaaatataccctcaagctagttcatcaaacaggccagttaggctatggaatgaacaaacaggaaggaaagggtattgccacctcagggaatactgtcacagaactcttcctccctgtacctatttttccctcctctctctctgacttcattctttccaactgcaaaccagcttttcaatgaaaaatgagctatcctgagatgcntattttcccagtttcaccaccaaaaggaaaagccctctattttctagattcaacctgagaaattctggggaaggattcaaatgcttcagtaaggtgtcctgcggtgataccaacttgagataacttaaatttattttatggcttgaggtttctaactatgccatgctattcttatcccaaaactatgtgaggattgatgtatagttgtgaattgttgagttctgtgcctggcctacagattaaccagttacaaaaaggttagaaattctgatcagtctacttttggtcagtatgtccctcaacttacttatcactgtggccaagaaggtgagtttatgtaaagatatggcatctnccgttcaaccacagttaagggtaaaagggactgaggtcagaaaaaaggaattcctcagaagaagcaggtattcttgtccaaggaacaggtgctagacagtggaaacataaaaatccaactcaaaccaaataaagtatagactaaattgacattgatacattctcacaaacagatattatacagctcctaagaactttacaggagaatatttaataatatgaaaatatgctcataatactttaagtgataaaaagcaatttttaaaattatgaaaattattccattttaaggaggcaaatatatttctaaaaatacatgtacatgggccaggcacggtggctcacgtctgtaatcccagcaatttgggaggctgaggtgggcggatcatgaggttaggagatcgagaccatcctggctaacacagtgaaaccccctctgataaaaatacaaaaaattagccaggtgtggtgcaggcgcctataatcccagctactcaggagtctgaggcaggagaatggcatgaacctgggaggcggagcttgcagtgagctgagattttgcaactgcactccagcctgggctacagagcaagactccacctcaaaaaaaaaaaaaatacatgtacatgtagaaaaaagactggaaggtgatacatgaaaatgtcaatacgatctcagtctttacctactgaacagaggatgttgtacactgattacatttaccctttccttccataggatcatagaagtgttcctattagggagaattcaggccgtctcaatttctgaaggctgggaagtccaagaggatagcactggcatctggcaagggccttcatgctgcatcatcccatggtggaaggcagaagggaaaagaatcaatcagaatgatggacacagcatctttatggcctatctagtttactgtagtttttatgggcttaagaagaagaccaccttgtctaatcatgaaattttgaaaaatttaaacataaaaaataaaattcctacattctggaacttttcagcaaa

SEQ ID NO: 288932 - DNA, 3296 bp, Homo sapiens
tgtacttctgccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288933 - DNA, 2545 bp, Homo sapiens
tgtacttctgccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcaataaagaatcttacttaagccaggtgcggtggctcacgcctgtcatctcagcactttgggaggccaaggcgggaggatcacttgaggtcaggagttcgagaccagcctggccagcatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccctattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctc

SEQ ID NO: 288934 - DNA, 910 bp, Homo sapiens
gctgtacgccgattcgggatgtcctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggggatcaggtccttcccagtgatgcctaggggggggggcccgtggccaaaccgcggtcgggcaccggggaaacagggccggggcacaaggggcccaaaacaaaaaa

SEQ ID NO: 288935 - DNA, 1054 bp, Homo sapiens
tgtacttctgccttttgctctcagatgctgccagggtccctgaagagggaagacacgcggaaacaggcttgcacccagacacgacaccatgcatctcctcggcccctggctcctgctcctggcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacacccggaagtgggatcacgtcactccagtgatgcatagtgggggggggacctgggagcatgaccgtgaggtcacagcgcagaacccggagcaacgaagggtccgggcaaggtggaccagctgaaaacgaaaattcagcaactggcaatgccaggcaagggagagggaggccaaacgggccggaggagggaaatgccaagaaccgcacacagaacaccccgggagaaacacaagagggacccccaagaacacgaaagaggagagcaccgcgcgaaaacagaggcacaagcacaa

SEQ ID NO: 288936 - DNA, 2749 bp, Homo sapiens
gctgtacgccgattcgggatgtcctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288937 - DNA, 2853 bp, Homo sapiens
tgtacttctgccttttgctctcagatgctgccagggtccctgaagagggaagacacgcggaaacagatacccagcagcctttggcatgagccatgtggcccgaggagataaacagacagagagaggaacattgatgcgtgtgaaatgttggcaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288938 - DNA, 3754 bp, Homo sapiens
gctgtacgccgattcgggatgtcctgaagagggaagacacgcggaaacaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288939 - DNA, 3197 bp, Homo sapiens
cacgaggagacacgcggaaacagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288940 - DNA, 3240 bp, Homo sapiens
tgtacttctgccttttgctctcagatgctgccagggtccctgaagagggaagacacgcggaaacagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288941 - DNA, 3082 bp, Homo sapiens
  misc_feature (2946)..(2946): n is a, c, g, or t
gctgtacgccgattcgggatgtcctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaaaaaaaaaaaaaaaaaaaaaaatcgggggcttttttgggggggggggaaaaaggggtatcagaatggggcacaggggtcattaggcgtgtttctgtgaccaaggttttctgtggtaccaaggggggcgtaagaacctcgccgcggcgctcgtccccaatatataggagagacggcgcgagatatgtaaancttctcgcgagatataaagcggccgaggcggttatgaccacggcgcgactataattgagaactcccgcacgcaggaaaaaaccacccccacgcaagcgagaaccgaaacacccaaacgacagaaccccaaatcagg

SEQ ID NO: 288942 - DNA, 3174 bp, Homo sapiens
gctgtacgccgattcgggatgtcctgaagagggaagacacgcggaaacaggcttgcacccagacacgacaccatgcatctcctcggcccctggctcctgctcctggagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288943 - DNA, 3249 bp, Homo sapiens
tgtacttctgccttttgctctcagatgctgccagggtccctgaagagggaagacacgcggaaacaggcttgcacccagacacgacaccatgcatctcctcggcccctggctcctgctcctggcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288944 - DNA, 3539 bp, Homo sapiens
gctgtacgccgattcgggatgtcctgaagagggaagacacgcggaaacaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288945 - DNA, 3758 bp, Homo sapiens
gctgtacgccgattcgggatgtcctgaagagggaagacacgcggaaacaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgagatcggaggatcgtttgagcccaggagtttgagaccagcctgggtaacatggcaagaccctgtctctacaaaatgtttaaaaaactagctaggtgtggtggcttacacctgtaatcccagcactttgggaggccaaggcgggaggatcacttgaggtcaggagttcgagaccagcctggccagcatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288946 - DNA, 2907 bp, Homo sapiens
gaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288947 - DNA, 2709 bp, Homo sapiens
tgtacttctgccttttgctctcagatgctgccagggtccctgaagagggaagacacgcggaaacagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288948 - DNA, 2164 bp, Homo sapiens
actggccaatcctctgtccttccctgcatttcggtgcgccattgtggtaccacgtgtaatttgttggaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288949 - DNA, 2245 bp, Homo sapiens
gctgtacgccgattcgggatgtcctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacaaacatataacctatgccaataaaaatgtctcagcaacagtg

SEQ ID NO: 288950 - DNA, 2688 bp, Homo sapiens
gctgtacgccgattcgggatgtcctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacaactggtgtggattaacctgccagggagacagagctcacaataaaaatggctcagatgccacttcaaagaa

SEQ ID NO: 288951 - DNA, 1995 bp, Homo sapiens
ccccgactagcccgacagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288952 - DNA, 2012 bp, Homo sapiens
  misc_feature (46)..(46): n is a, c, g, or t
tggtacaggtcccgagtccttgggatctgaagagggaagacacgcngaaacagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288953 - DNA, 1839 bp, Homo sapiens
tgtacttctgccttttgctctcagatgctgccagggtccctgaagagggaagacacgcggaaacagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288954 - DNA, 2311 bp, Homo sapiens
  misc_feature (46)..(46): n is a, c, g, or t
tggtacaggtcccgagtccttgggatctgaagagggaagacacgcngaaacagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288955 - DNA, 1222 bp, Homo sapiens
cgggtcccttaacgcgttagccgaaggccctgtggttggccgacaatttatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288956 - DNA, 1878 bp, Homo sapiens
gctgtacgccgattcgggatgtcctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttgctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 288957 - DNA, 1842 bp, Homo sapiens
gctgtacgccgattcgggatgtcctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcagttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaatactgctgatggaacctccctgcccacagggctggcattccccagtgtgtgcccctggatggcgaaatctccccaaatttggcttaccgttgatccgaaattccatgc

SEQ ID NO: 288958 - DNA, 5701 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288959 - DNA, 433 bp, Homo sapiens
atggtctcgatcttctgacctcatgatccgcccgcctcgacctcccaaagtgctgggattacaggcatgagccaccgtgcccggccctaacaatattattatataacaagattactttccaaaaatttaacaaatcgttttgtatattgagattttttgcttttagagagcagacaaaatggctatgaggcagtgtacaagtttgtatgatcagaaagagcaaaattacctctgttctctcattttgcaggagcagtagagaactgtggactattctgcttggaaggtcagctctgagagagctgagtcagattgaggcagaactgaataaacattggcggcgattgttagaggggctttcttactacaaacctcccaggtatggcagttccgggtgtctggttaaagtaattgtcctaaggaagctgacatg

SEQ ID NO: 288960 - DNA, 285 bp, Homo sapiens
agggcgagcgggcgcgcgaagatggcggcggccgccggcgggccgtgtgtgaggtgcggagcgggtcgaatggaccggggtggctgtgaagcgcggtgtcaaagccgagcggaagcggggcgggaattggaggcgggatgtggcgacagtggcagggccaaccccggctggatggacgggcaccgagacgggaggcggttacgtccaaacggtccccgcgcgcggggatctgaagagtcttcttcaggaggggggccggctcttcacccctttcctccgcgctcg

SEQ ID NO: 288961 - DNA, 5668 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatgccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288962 - DNA, 3448 bp, Homo sapiens
aggtataaatgaacatgatattttttattagatatttccaaattaccttccaaaaaacattgtaacagtttatacttataacaccaagtattctatcgttgctgcaaggtcttcatcattgtttagtctttgccaatctaataagcaaaaaaatgtttcacttttcagtttgtatttatttaaccatgagggaagttgagcatttctttatactgattactgtctttcctgtgaatttgcgggcatctcatgcttgtttgtggtgatgtcccttttagcccagagctgtagtctggatgcttccctttctgccaattttctgggagctcttcagtgcccttctgtgggagcccattgaggtttttgtggaagcagagctctaagcctgtgtgttccggtctccaccaggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288963 - DNA, 3569 bp, Homo sapiens
aggtataaatgaacatgatattttttattagatatttccaaattaccttccaaaaaacattgtaacagtttatacttataacaccaagtattctatcgttgctgcaaggtcttcatcattgtttagtctttgccaatctaataagcaaaaaaatgtttcacttttcagtttgtatttatttaaccatgagggaagttgagcatttctttatactgattactgtctttcctgtgaatttgcgggcatctcatgcttgtttgtggtgatgtcccttttagcccagagctgtagtctggatgcttccctttctgccaattttctgggagctcttcagtgcccttctgtgggagcccattgaggtttttgtggaagcagagctctaagcctgtgtgttccggtctccaccaggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggtaagcctgtaacctgggatgacactgggagttggctcactgggaggcagatgctgggctctgcaagtacagctgctggcagtggctgtggaactgaactcttacctgtcccttcttgcaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288964 - DNA, 4247 bp, Homo sapiens
aggtataaatgaacatgatattttttattagatatttccaaattaccttccaaaaaacattgtaacagtttatacttataacaccaagtattctatcgttgctgcaaggtcttcatcattgtttagtctttgccaatctaataagcaaaaaaatgtttcacttttcagtttgtatttatttaaccatgagggaagttgagcatttctttatactgattactgtctttcctgtgaatttgcgggcatctcatgcttgtttgtggtgatgtcccttttagcccagagctgtagtctggatgcttccctttctgccaattttctgggagctcttcagtgcccttctgtgggagcccattgaggtttttgtggaagcagagctctaagcctgtgtgttccggtctccaccaggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggtaagcctgtaacctgggatgacactgggagttggctcactgggaggcagatgctgggctctgcaagtacagctgctggcagtggctgtggaactgaactcttacctgtcccttcttgcaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaagtaagtctgcctctgggagtagtttcattgttctggtctataaaatgggagtaataatagctcttatcccagaggtttgttgtgacagttcactgggaataagagtgcttagtcctggttcaatacctgggagttttacactaattctctttctaatgctgctgcaagtattaaggatctttaaatattaagcacctggaaggttcagttgcttttgtgttcctgccttttgctaactagctgcatcaaaactcattattcttgagaaacagtagattcaggagagaggcgcttgctcaagtcactggattgaatgaaacattccgttctattggacctgctggcacaaagggaaggagtgttaaaaggctaaatttgggagtctgctgtcttatttccctccctcctcttctgtggggcttttgggaatctacagtggaaggaatcttgaagagtttttattgatcaactctataatgcataagtgtgattcatgagaggaaaatgtaattttatctatggaaacctttcatttatacgggaacaactgacttatcagacacatattaggattgagactggtaaaatatgaagtgaccaccaaagggagcttgagagaggagaaaatgactgtgagagggaaaaagttatgatttcaaacatttatttcctttttagacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288965 - DNA, 5998 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagacagctgtgtgatgtttaacttcaaagcccagggatgacaacgtggctctcagaacctagaaaactcccctggccaggcgcctgggagtggggctgcagcctcgggggaaggcaggtactgatggatggctagttcaccagcatctcctcattcctgtccttgggctgagggtttggctgggtgggcgctgtcagatattcccttccttggcctgcgctggtcctgtccttgaccctgctttcattggcccagtgggctgagctcatccctgggtgagcctttcttgaagctctgtgcct

SEQ ID NO: 288966 - DNA, 5634 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288967 - DNA, 5614 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288968 - DNA, 5855 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcaggtaggaggccagcccgaaggcaggagggagcgtccttgcttgcctgggtgggttctgacaatcccagaagctgtgatctagcctgagagccctacctaccctaggcagggcaggggcaggctccatctcatttcctgtctttccctcctcccagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288969 - DNA, 4985 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtgggggcccaagatggtgtcttggagtctggggtaatgcttggagacagggaggctgtgaggtctcactggggcactcctagtgaattgcaggatgttcctgaacgggggcttttcccttggggagcacagggtttgctgtcatgtgcttactctggctaaatgtttccttccatagtcaagggcagccatgtaggttaagaatttggacttttatcagttagatcttggttcagatcccttaagaatacacttggggccgggcatggtggctcacgcctgtaatcctagcactttgggaggcagtcaggagttcgagatcagcctggccaacatggtgaaaccctgtctctactaaaaatacaaaaattagctgggcgtggtggcacgtgactgtaatcccagctactcgggaggctgagttgggagaatcgcttgaacctgggaggcggaggttgcagtgagctaggatcgaaccattacactccagcctgggtgacagagcgagactccgtccc

SEQ ID NO: 288970 - DNA, 1678 bp, Homo sapiens
ggcacgaggacttgcttctgcctccgtacacccatgtggcgtcgcgtctcagcaggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288971 - DNA, 1182 bp, Homo sapiens
  misc_feature (40)..(41): n is a, c, g, or t
gaggcagtaatataaggtcatatggtacgaggctgggtgnnctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288972 - DNA, 1014 bp, Homo sapiens
aaaggcccccaaaaagggaaccccggtcgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288973 - DNA, 4338 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagacagctgtgtgatgtttaacttcaaagcccagggatgacaacgtggctctcagaacctagaaaactcccctggccaggcgcctgggagtggggctgcagcctcgggggaaggcaggtactgatggatggctagttcaccagcatctcctcattcctgtccttgggctgagggtttggctgggtgggcgctgtcagatattcccttccttggcctgcgctggtcctgtccttgaccctgctttcattggcccagtgggctgagctcatccctgggtgagcctttcttgaagctctgtgcct

SEQ ID NO: 288974 - DNA, 4041 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagtattctttctagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagaca

SEQ ID NO: 288975 - DNA, 3610 bp, Homo sapiens
  misc_feature (3460)..(3460): n is a, c, g, or t
  misc_feature (3468)..(3468): n is a, c, g, or t
  misc_feature (3504)..(3504): n is a, c, g, or t
  misc_feature (3513)..(3513): n is a, c, g, or t
  misc_feature (3517)..(3517): n is a, c, g, or t
  misc_feature (3539)..(3539): n is a, c, g, or t
  misc_feature (3551)..(3551): n is a, c, g, or t
  misc_feature (3604)..(3604): n is a, c, g, or t
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattacttctagttncaagcctnaagtgaactggccttcgcctttggcttcatgaaagngcactctgntggnttatccttccttccgggcaagngggaaaaaaaanaagttaagggttcttgggggattgaaatccctttggacccctttggacggganaatccc

SEQ ID NO: 288976 - DNA, 3454 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagagagtactttcccctcttgagattttaactgaaggttgggggagtgggagttggtggcctatccactgggtgcatggctggaagagccaaggcagaggagagaactggtttggaaccattcatggaaggccagtgagctgtgttcctggccaatccaccgatggcatttatgattgtcagaaagagttattgtgaagcaaactccatgcaactgggattttatggaggaggaatcctggaaaggcctcagcctaacccacacgttggaggtgtcctg

SEQ ID NO: 288977 - DNA, 4169 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaagtaagtctgcctctgggagtagtttcattgttctggtctataaaatgggagtaataatagctcttatcccagaggtttgttgtgacagttcactgggaataagagtgcttagtcctggttcaatacctgggagttttacactaattctctttctaatgctgctgcaagtattaaggatctttaaatattaagcacctggaaggttcagttgcttttgtgttcctgccttttgctaactagctgcatcaaaactcattattcttgagaaacagtagattcaggagagaggcgcttgctcaagtcactggattgaatgaaacattccgttctattggacctgctggcacaaagggaaggagtgttaaaaggctaaatttgggagtctgctgtcttatttccctccctcctcttctgtggggcttttgggaatctacagtggaaggaatcttgaagagtttttattgatcaactctataatgcataagtgtgattcatgagaggaaaatgtaattttatctatggaaacctttcatttatacgggaacaactgacttatcagacacatattaggattgagactggtaaaatatgaagtgaccaccaaagggagcttgagagaggagaaaatgactgtgagagggaaaaagttatgatttcaaacatttatttcctttttagacccaagttttgggaaaatttaaccagtccgctgtttggaaccctttctcctccctctgaaacatcagaggtaagctgtggcagagggcaggatggtggctacaagtcccttggaggaaaggctgtgggctgtgagatggggccgtagacaatgatacctcccctaattaaacaacagaatgttcccttcactagaaacgtctttctcagggaagtgccagctttctgtccctttgatgtcttgctttgggaaggaaagtggtttgcgctactgtgtgttggtggctctgtggtcttctccattcagttggagacgttgtggacctgacgcctctgctcttgcaagtcaggacattcacattcaacaggggttgtgctaacttgttctgcaagtgttgggcccctgctctgttccctgtttgatatactgggggagatcagtgatcagagatg

SEQ ID NO: 288978 - DNA, 2352 bp, Homo sapiens
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggtacagtctgattttgttcacaaagggcagaaaaagaaaaggtccagtcttgtcagatgactctgaaatagtttccctggcccctggtgctgtaatcttcttgtctgtaggcagaatagtcatcttgaagttacagtgacaacagtttctatgtattgagtacctagtatgtgccagttatgtactctattaggtgcttaattatgtgaatttatttaatgattggaaggtttatgaagtagaatggaagaggcc

SEQ ID NO: 288979 - DNA, 1746 bp, Homo sapiens
  misc_feature (1717)..(1717): n is a, c, g, or t
agggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactccagcgatcttnggcaagaaagggatcctctagatagacct

SEQ ID NO: 288980 - DNA, 310 bp, Homo sapiens
tgttcctgttgtcttagttttttacccttgcttctcttcagctggacaagaaaaaggagcccctcacccaggcagtggggctcagcacacaggcagaagggaccaggacgttaaagtaagtgctctttctgggatttgataaggggctggggcagtcatgggcccactgttctcaagcttggccagcctggccctctgcagcagtaccaaaaacctgtgtctcctcccaggtccctcctgatgtttaccatggaaaactgcttctacctgctcatctctcaggcgatgcggtaccttagggacccggctg

SEQ ID NO: 288981 - DNA, 427 bp, Homo sapiens
gtagggctccttctccacgttccctttgtctgtctttattgtgcctgcatgttactaataactccagtttaagttaacttgcagtagcttttagaagacgacattgttcttcctaggacatagcctttacataccctagtggctgctgtatagattggcgtatagcaaagggagttgattactcctcctctctcctagtttggactggggcctctaacagaagctgttgaactctgggattattgttggaatctaattcatgagagcacatatattgcgaatgaagtcatactgtctgaatcatctttggtttccatttggcaccctagtgatggggcagagggccaggggcagggccagctgctgatcaagacagtgaaactggcattctccgtcaccaacaatgttattcggctgaaacctcctt

SEQ ID NO: 288982 - DNA, 316 bp, Homo sapiens
agggaaggagggagagaaggggagcatgagggaaggagggagagaagagcagcagcgagtgaggagcgcatgggtgttacatggagggctattgggttggtctggttgggtgactgggctgctgacaagagaatccgctcatctctcctgtgtctctcccaggtcaacctgggttacttgtgccaggcatgtacctctctcctgcacagtcgaaagatgctgcagcattacttacaggtaagcgtcctatgccatgaggtcctggaatacctcacgctagcttcccaagctccaccttcatttcttgactctcctt

SEQ ID NO: 288983 - DNA, 590 bp, Homo sapiens
cagtagcggagggttgtcgatgccttcatttttgagatgctctaagtactctgctggctcactggccagctagtctgctgaaggacgggaacggtctcgggtcagaatcctggttgtaccactaagccatttctttgccaactcagcatttgggggcctgggacgttgcctctccacaggagggtaggtgtgggtatgtcaggtccctcagccatccccatctttccctgatgtgtgctttcctcccagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtgggggcccaagatggtgtcttggagtctggggtaatgcttggagacagggaggctgtgaggtctcactggggcactcctagtgaattgcaggatgttcctgaacgggggcttttcccttggggagcacagggtttgctgtcatgtgcttactctggctaaatgtttccttccatagtcaagggcagccatgtaggttaaga

SEQ ID NO: 288984 - DNA, 131 bp, Homo sapiens
ggccttgcacacagtccagtatggccttctcaagatcctcagcaagacgctggcagccctgcgccacttcaccccagatgtctgccagattctgctggatcaggtactgcccatcatctgttcagcaccac

SEQ ID NO: 288985 - DNA, 263 bp, Homo sapiens
gtggtcttcccactttagtgtttattggtgttttggtgtttttatttcaacagaatacaataataaagatagactggttcagctagggaaaatgatccatttttcttcccttcctcaaacaggatataattgatacagcatgtgaagtattggccgacccttctcttccggaactgttctggggaacagtaagtatgtcagagagagtcactgcatagcaaaagaattgttcaaacacttgttttcttacaggttttgtacta

SEQ ID NO: 288986 - DNA, 926 bp, Homo sapiens
cgcgcctcaggagccagtgtaggcgccgcaaagcggaaggggcgcgcggataggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtc

SEQ ID NO: 288987 - DNA, 1240 bp, Homo sapiens
ggcacgatggaagaagtgcctttcgcctcccaccatgattctgagacctccccagcaatgtggaactaaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtc

SEQ ID NO: 288988 - DNA, 514 bp, Homo sapiens
cacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatactttttttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactacacccattaaaaaataactcgccatttctctctctccccagcccctggcaaccaccattctttctgtctctgtgatttagattactctgtaagtatgttgtataaatagactcatacaatgttagt

SEQ ID NO: 288989 - DNA, 1458 bp, Homo sapiens
ggcacgatggaagaagtgcctttcgcctcccaccatgattctgagacctccccagcaatgtggaactaaggagattcctacttaccagttgttccatggtcacattttccttatacttgtaaatccacaatgctaaatattctatcggatccactgggcgaactcttgccacttctgcaagaccttgagttaaacaggccccaaggtgcttttgaagatatattgactccatttctaactcctaaaaagcatcttggctcaacataagaaagccctttcccacagaaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtc

SEQ ID NO: 288990 - DNA, 1208 bp, Homo sapiens
ggcacgatggaagaagtgcctttcgcctcccaccatgattctgagacctccccagcaatgtggaactaaggagattcctacttaccagttgttccatggtcacattttccttatacttgtaaatccacaatgctaaatattctatcggatccactgggcgaactcttgccacttctgcaagaccttgagttaaacaggccccaaggtgcttttgaagatatattgactccatttctaactcctaaaaagcatcttggctcaacataagaaagccctttcccacagaaacagctgcctccagcgtgaagaaggtgccacagagatggaaggagattccttacccacacctgggagacagctagccagccagccagccaactgggcgggggcacccgggcaggggtgccagatacagtattgtatctggcaacctcccggggcgctcagtgtggttttcccacccgggagtctggaagggtctcccgcagcccgcaggagacgcagcgctccccgctcagggggagcaggaggacagctggccgctttcgggagccccaggcgcgaagcggcctctctccgcctcaggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccagcccctggcaaccaccattctttctgtctctgtgatttagattactctgaatcatcctatgaccatagggagaaccatccttaatatgaagccaacacatggataatggcagagaagcaagagaacctcgactgttgatgacatcatgaaaccacaggatcacctcaaggcaactggaattgggttttctgttaacttgcaaatcaaagcttcctaactgaataaagactcagttaatgttagtt

SEQ ID NO: 288991 - DNA, 312 bp, Homo sapiens
tataaatggtatgaggtgaaggtccaccatcactcttggtgggtgtggatatctaattttctctgcaccattttttgaaaaggctgctcttccgctttaaatggtcttggcatccttggcaaaaatcagttggccataagatgtatggctttatgtctggtctctcaattccatttcttttgtccatatgtctgttcttatgccagcaccacactggtgtttttgattttgtttctttgagacaaggttttggtcttttgcccaggccagagtgcagtggcatgatcatagctcactgcaaccttaaacttt

SEQ ID NO: 288992 - DNA, 2964 bp, Homo sapiens
  misc_feature (32)..(32): n is a, c, g, or t
tgcggcccgggccgaggaaggagaagtgggangaggggggagctcggcgtcccgctccctccgcggctcatggcgacgactctcggcacatccgggaccctccggccgtggcggccgaggcgccggctgctcgggccccagccccggccgctgtggtgactccgccgcgcctcgccgtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagtaagtcttcagtccagagaccgaataggcacaggaggacaagttgtggactgcagtcgtttatttgataacgatttaccagacggctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactcccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattcta

SEQ ID NO: 288993 - DNA, 2302 bp, Homo sapiens
cctagattataaagtttcatgtggaagataacatgagtcttctcctaatagaatacggaagtttctaatttaataccatcttgtgaatccttgtatatagtctgaacttgacttcctcttcttgccaaaagctcaccaaggttacttacatctttgccctcttaacagactatagataaaccactttggattgatgttgacatctaatgaccaacactgggaattgccacatctaagttttattttactcaagaatatattttaaaactcttctgcaaatgcatgattcttattttagttttaaatgtattttagctctttaatttgaaaaaacttgtccattaactgtgctatgactcaaaggttaacttttagcacaatcattaaattataggcttgagtgacagacagacttaggacctaggttcgtatcctggctttgccatgtaacaccgagcacattatttaacctctttgagcctcaattttatcctctatagaggaaaataacagcaccaaccatctaggtttgttgcaagaaatcagtgatatctaatttcatgtgaaatgctggcacagtgtctggcatagtaaattttaactgtcattatcagtgttcagacctgagaagaaatactctcctgccatttctctttgagattataaggcaagctctttagagtgggagtggttatacttctacaatatttctgtgatttgaattttaaaaactgtacaaccaaaacataaaaataaagtggataccaaggctgaagttattacagctgtcctctatagtaatatgattttgtttataatctgtgaaagtttaaagtttaaatttattgacattatacgtttataaacaaattagatttatactaataaatattagtaatagttttttatgtattgaagtttctcactggattttgtctaaagaaaagtggttctgttgttctaaaaaaaaaagacaaaacaaaacccaccataaagaaacccttttagagattgttctcttcaccctggcctttcctctgtcttcccaaggattttgagttcattttgtccttgacttttttctccccagtgtgcgtgcttgctctttagtcctcttctttctaatttggctatttttccatctctatctgtttatgacatagaatgtctccccagtatctcatctgttttgcttctctttgagctcaaatgtaatcttgagaatatacctttgtctagcaaagagaaaacataagttttggtataaaattaggcataataagcattatcaacctccagactctttgaaaatttctggaagttcctcctcaaatcttcccaatgttggccagcctctttctcagagccttttatacatcatttaaaattttttagttattagtattgtgacaatcttgatttgttttccattgcaacatatttagtatttaagccacgttataagtttagtttgtttatggatagctggcctgtggccctcatcatttgtaaaattgtttccaagagacagaacaaatgatttgtaaagcccttttttgataataaataaaatagattggtaatttggagatttttccctattagtatatcatcttagtgtatataactgtctttgatctggacactctgaatgtttttgttatcagtgtttattaattttacagaacagaggacaacgcaacaaggccaggtgtatttcttacatacacagactggtgtgagcacatggcatgatccaagagtgcccaggtaagaacgtattttaagcactctttagaccatcaaagagccatttcacctaggatttctttgatttttaagaaatttttaccttttaaaaatagtttatgtaaaagtttgactcttctgatagttacttcagttttaacgtttagtagaaagtcctgcctactgctctgcaatcccacctcagttctcccctccctcaccagttcctagccaccctcccctgcttccccttaaaaaaaagtggaataggcagggcatggtagctcatgcctgtaatcccagcactttgggaggccaaggtgggcagatcatgaggtcaagagatcgaaaccatcctggccaacatggtgaaaccccatctctactaaaaatacaaaaatgagctgggcgtggtggcgcgtgcctgtaatcccagctactcgggtggctgaggcagggaatcgcttgaacccagggaggtggaggtttgcagtgagctgagatcacgccactgcactccagcctggccacagagcgagactctgtctcaaaa

SEQ ID NO: 288994 - DNA, 481 bp, Homo sapiens
tccttaagaccaacaattattaagactcagactaaagtggtctaaaagttttggagagaaagtgactgcatgttggcaatgtaatacaccagtgtttggtttttgaaatctgaactctttaaatgataggtttgatttctaatggattgtggaaatttattgtcactctatagatgttagaatctctgataccagctaattttttcgttgctttctttgttgacttcaaatagatcagaggttggatttatgcaaactcgggccaaatgacaatgatacagttagaggacagatagtaggtaagtgtggaatttaaagttacatgaattttggtttcaaactgacctaaagtgtaaaataccttttaaatcaaagtataataactgtagcttcattgtgttggcctgaattaaatgagccaggtaaaatgttacagtgaatccaggatccaggttaacttaatttaaaaaactttaatgta

SEQ ID NO: 288995 - DNA, 5031 bp, Homo sapiens
  misc_feature (32)..(32): n is a, c, g, or t
tgcggcccgggccgaggaaggagaagtgggangaggggggagctcggcgtcccgctccctccgcggctcatggcgacgactctcggcacatccgggaccctccggccgtggcggccgaggcgccggctgctcgggccccagccccggccgctgtggtgactccgccgcgcctcgccgtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagtaagtcttcagtccagagaccgaataggcacaggaggacaagttgtggactgcagtcgtttatttgataacgatttaccagacggctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactcccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttggtgttgaagatctgcatctgattttgaaacgtccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaagctgcaaaatttaaagttatcaagtaaataggtcctctgtgttctgtttcatgtgatggagtgggtttcagtctgtgttcttggagccaaagggttcctcaggggtgcctcaggagtaatggtttaagagaagaggggcaatgagagggagcgagggggaaggcctagttggtatttgagcaggggccttaggctccatatccccaccccctttacccagaacagcccatttttcttatgtatattggaatttcaagtaagctttcatggggtgcagtggggcggggaggaatggatgggataaaaaaagtggagattttgctgctttaaaaaagttgagaactacttgtgtagtttttaagtattttaatgtatttcatttggccaaattcaactgccacaagcaagctagtcatagttgtaactgtgcagtggtaatatgcttatgcctacctttttcctctcaaacaatttgttttttttacattgcattctgagtactgaagagcatcttgaaatgtatggaagtggtttctatgctatttgataatcagtaatgttcagctgtcatgatagtactttactggttgcagacccatctctcttttatattaaagcactagtgcagtttataattgtgcctacttttaaaatctttcagtaaaaaagtacataatgaatacagaaatcataactgacagggatacagtaataatgaaatgctactatcacttattttaatatacaatataaagcaggcaaataccattgctttttgagtgcctttttaactttatactaatgacttaatagagctttaaaagaaagaaattggctgggcatggtggctcacacctgtaatcccagcactttgggaggccgaggtgggcggatcacctgaggtcaggagttcgagaccagcctggccaacgtggtgaaaccctgtctctactaaaaatacaaaatttagccgggcatggtggcgcactcctgtaatccaactacttgggaggctgaggcaggagaattgcttgaatctgggaggcagagattgcagtgagccgagatcgcaccactgcactccagcctgggcgacaagagtgagactccgtccccgccc

SEQ ID NO: 288996 - DNA, 5720 bp, Homo sapiens
cctagattataaagtttcatgtggaagataacatgagtcttctcctaatagaatacggaagtttctaatttaataccatcttgtgaatccttgtatatagtctgaacttgacttcctcttcttgccaaaagctcaccaaggttacttacatctttgccctcttaacagactatagataaaccactttggattgatgttgacatctaatgaccaacactgggaattgccacatctaagttttattttactcaagaatatattttaaaactcttctgcaaatgcatgattcttattttagttttaaatgtattttagctctttaatttgaaaaaacttgtccattaactgtgctatgactcaaaggttaacttttagcacaatcattaaattataggcttgagtgacagacagacttaggacctaggttcgtatcctggctttgccatgtaacaccgagcacattatttaacctctttgagcctcaattttatcctctatagaggaaaataacagcaccaaccatctaggtttgttgcaagaaatcagtgatatctaatttcatgtgaaatgctggcacagtgtctggcatagtaaattttaactgtcattatcagtgttcagacctgagaagaaatactctcctgccatttctctttgagattataaggcaagctctttagagtgggagtggttatacttctacaatatttctgtgatttgaattttaaaaactgtacaaccaaaacataaaaataaagtggataccaaggctgaagttattacagctgtcctctatagtaatatgattttgtttataatctgtgaaagtttaaagtttaaatttattgacattatacgtttataaacaaattagatttatactaataaatattagtaatagttttttatgtattgaagtttctcactggattttgtctaaagaaaagtggttctgttgttctaaaaaaaaaagacaaaacaaaacccaccataaagaaacccttttagagattgttctcttcaccctggcctttcctctgtcttcccaaggattttgagttcattttgtccttgacttttttctccccagtgtgcgtgcttgctctttagtcctcttctttctaatttggctatttttccatctctatctgtttatgacatagaatgtctccccagtatctcatctgttttgcttctctttgagctcaaatgtaatcttgagaatatacctttgtctagcaaagagaaaacataagttttggtataaaattaggcataataagcattatcaacctccagactctttgaaaatttctggaagttcctcctcaaatcttcccaatgttggccagcctctttctcagagccttttatacatcatttaaaattttttagttattagtattgtgacaatcttgatttgttttccattgcaacatatttagtatttaagccacgttataagtttagtttgtttatggatagctggcctgtggccctcatcatttgtaaaattgtttccaagagacagaacaaatgatttgtaaagcccttttttgataataaataaaatagattggtaatttggagatttttccctattagtatatcatcttagtgtatataactgtctttgatctggacactctgaatgtttttgttatcagtgtttattaattttacagaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactcccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttggtgttgaagatctgcatctgattttgaaacgtccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaagctgcaaaatttaaagttatcaagtaaataggtcctctgtgttctgtttcatgtgatggagtgggtttcagtctgtgttcttggagccaaagggttcctcaggggtgcctcaggagtaatggtttaagagaagaggggcaatgagagggagcgagggggaaggcctagttggtatttgagcaggggccttaggctccatatccccaccccctttacccagaacagcccatttttcttatgtatattggaatttcaagtaagctttcatggggtgcagtggggcggggaggaatggatgggataaaaaaagtggagattttgctgctttaaaaaagttgagaactacttgtgtagtttttaagtattttaatgtatttcatttggccaaattcaactgccacaagcaagctagtcatagttgtaactgtgcagtggtaatatgcttatgcctacctttttcctctcaaacaatttgttttttttacattgcattctgagtactgaagagcatcttgaaatgtatggaagtggtttctatgctatttgataatcagtaatgttcagctgtcatgatagtactttactggttgcagacccatctctcttttatattaaagcactagtgcagtttataattgtgcctacttttaaaatctttcagtaaaaaagtacataatgaatacagaaatcataactgacagggatacagtaataatgaaatgctactatcacttattttaatatacaatataaagcaggcaaataccattgctttttgagtgcctttttaactttatactaatgacttaatagagctttaaaagaaagaaattggctgggcatggtggctcacacctgtaatcccagcactttgggaggccgaggtgggcggatcacctgaggtcaggagttcgagaccagcctggccaacgtggtgaaaccctgtctctactaaaaatacaaaatttagccgggcatggtggcgcactcctgtaatccaactacttgggaggctgaggcaggagaattgcttgaatctgggaggcagagattgcagtgagccgagatcgcaccactgcactccagcctgggcgacaagagtgagactccgtccccgccc

SEQ ID NO: 288997 - DNA, 3552 bp, Homo sapiens
gagagagagagagagagagagagagagagagagagagagagagagagagagaggttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactcccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttggtgttgaagatctgcatctgattttgaaacgtccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaagctgcaaaatttaaagttatcaagtaaataggtcctctgtgttctgtttcatgtgatggagtgggtttcagtctgtgttcttggagccaaagggttcctcaggggtgcctcaggagtaatggtttaagagaagaggggcaatgagagggagcgagggggaaggcctagttggtatttgagcaggggccttaggctccatatccccaccccctttacccagaacagcccatttttcttatgtatattggaatttcaagtaagctttcatggggtgcagtggggcggggaggaatggatgggataaaaaaagtggagattttgctgctttaaaaaagttgagaactacttgtgtagtttttaagtattttaatgtatttcatttggccaaattcaactgccacaagcaagctagtcatagttgtaactgtgcagtggtaatatgcttatgcctacctttttcctctcaaacaatttgttttttttacattgcattctgagtactgaagagcatcttgaaatgtatggaagtggtttctatgctatttgataatcagtaatgttcagctgtcatgatagtactttactggttgcagacccatctctcttttatattaaagcactagtgcagtttataattgtgcctacttttaaaatctttcagtaaaaaagtacataatgaatacagaaatcataactgacagggatacagtaataatgaaatgctactatcacttattttaatatacaatataaagcaggcaaataccattgctttttgagtgcctttttaactttatactaatgacttaatagagctttaaaagaaagaaattggctgggcatggtggctcacacctgtaatcccagcactttgggaggccgaggtgggcggatcacctgaggtcaggagttcgagaccagcctggccaacgtggtgaaaccctgtctctactaaaaatacaaaatttagccgggcatggtggcgcactcctgtaatccaactacttgggaggctgaggcaggagaattgcttgaatctgggaggcagagattgcagtgagccgagatcgcaccactgcactccagcctgggcgacaagagtgagactccgtccccgccc

SEQ ID NO: 288998 - DNA, 3218 bp, Homo sapiens
gtgaagttgtatttctgctacatgtatttatatggggtgcctgtgcgaactgaaatggattctatagacggctcttttgctgtcagcccagtttgagtcatgaaatctaaatttgcatcaggtcgtcatctttttgaatgtgtgcctatgtattttaccttggatttgcctgattacttttcttctcatgcttttgggatattgactttctataaaagatagaaattgagaaagggatttcaatcttgagttttttctcaaatggaaatgtgaacctattacggaatctaagccttatccaaggttaattctggctcttaaaacccagatgcttttcctgctgccctttggtagtatgtgtggattcattagcattcccctatccccagatcctgtggttaacttaccagttttattcttaagattttggagactaatgcacgcacctgcagtgatttcatccacatttccttcatttgcaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactcccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttggtgttgaagatctgcatctgattttgaaacgtccagatttagctttcaaggtgcgtgcatgttgaatgatccagaagcaacgaaaactctggggtgagggattgaaaaaatctgaaatcacagttggatttttaaattcaaccatcaaaaatatgtactatcagtttttttttacattgatgtgaaataagcaaattttcatgataattaagctgcaaaatttaaagttatcaagtaaataggtcctctgtgttctgtttcatgtgatggagtgggtttcagtctgtgttcttggagccaaagggttcctcaggggtgcctcaggagtaatggtttaagagaagaggggcaatgagagggagcgagggggaaggcctagttggtatttgagcaggggccttaggctccatatccccaccccctttacccagaacagcccatttttcttatgtatattggaatttcaagtaagctttcatggggtgcagtggggcggggaggaatggatgggataaaaaaagtggagattttgctgctttaaaaaagttgagaactacttgtgtagtttttaagtattttaatgtatttcatttggccaaattcaactgccacaagcaagctagtcatagttgtaactgtgcagtggtaatatgcttatgcctacctttttcctctcaaacaatttgttttttttacattgcattctgagtactgaagagcatcttgaaatgtatggaagtggtttctatgctatttgataatcagtaatgttcagctgtcatgatagtactttactggttgcagacccatctctcttttatattaaagcactagtgcagtttataattgtgcctacttttaaaatctttcagtaaaaaagtacataatgaatacagaaatcataactgacagggatacagtaataatgaaatgctactatcacttattttaatatacaatataaagcaggcaaataccattgctttttgagtgcctttttaactttatactaatgacttaatagagctttaaaagaaagaaattggctgggcatggtggctcacacctgtaatcccagcactttgggaggccgaggtgggcggatcacctgaggtcaggagttcgagaccagcctggccaacgtggtgaaaccctgtctctactaaaaatacaaaatttagccgggcatggtggcgcactcctgtaatccaactacttgggaggctgaggcaggagaattgcttgaatctgggaggcagagattgcagtgagccgagatcgcaccactgcactccagcctgggcgacaagagtgagactccgtccccgccc

SEQ ID NO: 288999 - DNA, 782 bp, Homo sapiens
  misc_feature (32)..(32): n is a, c, g, or t
tgcggcccgggccgaggaaggagaagtgggangaggggggagctcggcgtcccgctccctccgcggctcatggcgacgactctcggcacatccgggaccctccggccgtggcggccgaggcgccggctgctcgggccccagccccggccgctgtggtgactccgccgcgcctcgccgtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttgtgagtagatacgagtgcttttccaattaaaaaacatatatgtgtgtgtgtgtatatgtatttgtgcatatacatatatacatgcactatatatgtatcctcaaatatatatttaaaaataatatatatatttgagtatgttggtagggcttcaaacacaacttcttgtgcatgtctgaaacattggtaaaaattcctgatctaaatttattttgtagacttaa

SEQ ID NO: 289000 - DNA, 806 bp, Homo sapiens
  misc_feature (32)..(32): n is a, c, g, or t
tgcggcccgggccgaggaaggagaagtgggangaggggggagctcggcgtcccgctccctccgcggctcatggcgacgactctcggcacatccgggaccctccggccgtggcggccgaggcgccggctgctcgggccccagccccggccgctgtggtgactccgccgcgcctcgccgtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtaggtaagtgtggaatttaaagttacatgaattttggtttcaaactgacctaaagtgtaaaataccttttaaatcaaagtataataactgtagcttcattgtgttggcctgaattaaatgagccaggtaaaatgttacagtgaatccaggatccaggttaacttaatttaaaaaactttaatgta

SEQ ID NO: 289001 - DNA, 373 bp, Homo sapiens
catgcagccgttttgttttttaggtatattggaaagtctgattcagttacgatcagtgtatggaatcacaagaagatccataagaaacaaggtgctggatttctcggttgtgttcgtcttctttccaatgccatcaaccgcctcaaagacactggttgtgagtagatacgagtgcttttccaattaaaaaacatatatgtgtgtgtgtgtatatgtatttgtgcatatacatatatacatgcactatatatgtatcctcaaatatatatttaaaaataatatatatatttgagtatgttggtagggcttcaaacacaacttcttgtgcatgtctgaaacattggtaaaaattcctgatctaaatttattttgt

SEQ ID NO: 289002 - DNA, 516 bp, Homo sapiens
gcctcggcctcccaaagtgctgggattacaggcatgagccaccgcgcccagctatgcctcttcttaattaagtacagtagtgactctgctatgcaccattactatggtgaaaaaggaattaggcttcttccatgaacgtaataaagtgtagaaaaccttagaattctaatattactcctaaagggaaaaatctatgggaaaagaaattataaattttagtagaaaccaaagagttcattctaaagtattaaaataagctaagtcagatgtcttctgaagatagaaattttagattataatagttctttctagttgtatgaatcttagtaatatttctgtcatttaatagtaagtcttcagtccagagaccgaataggcacaggaggacaagttgtggactgcagtcgtttatttgataacgatttaccagacgggtaagctaacatcactgaaatcattagagaaatatatagataatatccttaaaagaatagaaataagtgggtgtttattgta

SEQ ID NO: 289003 - DNA, 587 bp, Homo sapiens
gcagtgatttcatccacatttccttcatttgcaggtgctgcaggcccgagactctttaccatacaccagattgatgcctgcactaacaacctgccgaaagcccacacttggtaaggtatttttgtagctgtattccccattccatgtacataagtgttagttccaaacagatttgactttttatttattgtacttactagtgttaaatgggcctttaaagggaatgataagcaacttaagtgatttaaaagttaagattattcggaaattggtaggaaaacccaaaagtggtcatctctgttttagagaaataccttttagttttctgtgtgacacagagtgatgtggctatactggtatacacttgctaggccagtttacttattttgaatgaactgtataaaatttgatttgcttattcacagcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcag

SEQ ID NO: 289004 - DNA, 2088 bp, Homo sapiens
gcatatcagaaatgcattttaatttttatttgaaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 289005 - DNA, 2724 bp, Homo sapiens
gaccctcagggcccgcagtttacagggtgaaagtctcccagctcctccgggaagggaggaggagggttctcggtgagcggctgccccctcgtccaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 289006 - DNA, 3006 bp, Homo sapiens
ggacaggctggcccaccttgcctcaaaaccaccaagccccttaggagtccccttgctccccagcccctccaagacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaaggacacccagctagtgaaggccaccagagccaggatgcctgattctaagtcaagagaatttctaccaccccacactggcagccgaaggaggcaggcagggcagcaaacaggcagtttccttccttctctccctggaaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 289007 - DNA, 2874 bp, Homo sapiens
agccggtttcccagcgggattccggtggaggagtcaggaggagtcctgagcaaaggaacttggaggaatgagggagaggacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 289008 - DNA, 2536 bp, Homo sapiens
gttattatccccatatttaaaatggaggaaggccagagaggtaaagtggcttatcctaggacacccagctagtgaaggccaccagagccaggatgcctgattctaagtcaagagaatttctaccaccccacactggcagccgaaggaggcaggcagggcagcaaacaggcagtttccttccttctctccctggaaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 289009 - DNA, 1835 bp, Homo sapiens
tggagaaaagataagtcttttgaaaaattgctgctgcctggaaatagtcaaaacatctctgttgtgggattttagagtgggtatgtttggtggtaggttgtcctagggtgagcctttgtaataagtagcagtgtgtttcctggaagtaaggaggaaggagagttgcccagccactgtgtgataaggcagtagcagaaagagagatgaggaggccaaatgttcttacccctaccacacgctgtctcagtcttcagatgagttcctggatgaacccctcccccctgtccaccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 289010 - DNA, 2578 bp, Homo sapiens
ggacaggctggcccaccttgcctcaaaaccaccaagccccttaggagtccccttgctccccagcccctccaagacctggacttggctgtgccagagacggccagactggacagcagtttacacaaggcccgggcccaactgttggccaagggccggagacaccggccatcccgctccaggcttcgggacagtgccagctccgcggaggatggtgaaggctcggatgggcccggaggcaaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaaggacacccagctagtgaaggccaccagagccaggatgcctgattctaagtcaagagaatttctaccaccccacactggcagccgaaggaggcaggcagggcagcaaacaggcagtttccttccttctctccctggaaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaa

SEQ ID NO: 289011 - DNA, 2905 bp, Homo sapiens
gaccctcagggcccgcagtttacagggtgaaagtctcccagctcctccgggaagggaggaggagggttctcggtgagcggctgccccctcgtccaggtgaccgatggctgcgggagccccctgcaccggctgcgctcgcctttgcactcaggcccggggtccccggccgggggctctttctgcctggatcctccggggttgcggcgcagcctggacgaggacgagccgccgccctcgccgctcacacgctaccggcccctgcacaacgctgcgtcgcacgagggcctggccgccgcctcctgctctccgccgcgctccgcgccctcctccgacagctcccccagcttcgtgcgccgccacccgcgcgcagagccgcacagcgaagatgacagccgtgacgccagtcctcctgagcccgccagccccaccatcggcctcgataagaagactcgccgaaagttcctggacctgggggtcaccctgcgccgagcatccacgggcaagagccggaaggagaaaggcagcaaccgactgtccatgggcagcagggagtcagtggaggggtccggcaggtcagggggctccccgttcctgcctttttcctggttcacggacagcggcaagggctcagcatcctcgggtagcaccacctcccccacctgctcccctaaacacgagggcttcagccctaagaagtcagcttcccaggaatccactctgagtgatgactccacgccccccagcagcagccccaagatccccagtgggccctggcaggaggccaaatgttcttacccctaccacacgctgtctcagtcttcagatgagttcctggatgaacccctcccccctgtccaccactggaccagccagcaggtgggccagtggctgcagagcctcaacctggaacagtatgctgctgagtttgctgcacggcaggtagacgggccgcagctgctgcagctggacggaagcaaactaaagagcctggggctcagcaactctcatgaccgggcactggtgaagcgcaagttgaaggagatggcagcagctgccgagaaggagcgcaaggcccaggagaaggctgcgcggcagcgggagaagctccggcgccgagagcaggaggccaagaagagctaggggagggtgcacaggcgctggcacccggcaggggcagccactggctccgcgggcacaggcctcaccagggaggctggacctgggcgctgcacttgggctagcctggtcccacgctctcaggggggacatgctctctcttaccctgtcacttggtctagacccagagaccccagaaagggagaccccagggagagggcctagtaataaatcctattttgaggacttgtttggcacagagttcctgggggaggagcagatgaaggggagagggcagagaggccagggctgaggcaagtctgggaggctgggtcaggctgtcccattgccctcaggccatcgtggggctggggtggaggggagctaggaggcctgcctgcctgcttgcctgccagaggccctgaggccgggccccagggctcagagctgggctgggcatttcagcaggagcccatgtgggagcggctcctctccactcttccagggggctgtgtggtgggagagctctgtcctgctcccccaagaggccagtgggcgctgcagcaagtcgcactcagggtagactcccagccaaactcctcaacaggagcgcagagaaagcagcctggggcgagtgcagtctttgccaggactcaagaggggaggatgaacatccccttctccctctcccctcctctgtcctgtgggtcccagggggcgagatgacaccacacaggtctgcctctcagggcccattcaagacctggtctttgacccattctccaagccaggactcccttcacttcctgctgcttcctcagagggcacctaagtcctctttgggagctgagcaaacaggaactgatagggacagaggacaccacttccaccagccaaggcctaggagctgctgacctggtcagccctcaccccagccaggcagagaggcaaaacctgggggtccccggcagctacgagattggaaaggttcatcagccctcccccatctgccccaggcattgtcagggaatcagtgggctcagaactggcaggcggtgcaagctctgcttccctgggccacactgagggctggggccagctccctggatgggggtggagtttaccagcagcctggggacagcatgtgtcctttttaggaaatgtccttggaggaagtgttcatgtgtggcgctggtcagcagctagtcccgcttccaggacactggtcagagttaccgatgaggcctgggggctcccgcttggaaacccctccagctcctcccatctgcccagacagagcggcagatggcaccaatgcatgctggctccctcattcctgcccaggggctgtggcttacggccagcaccctgtacctgggactcagcccttatcccccctctgctatctgtgctgggagaggggcttcggagggaaacagatatgaggacactggcaccatctgggcctggtggcagggccatgggaggttggaaggcacccacatccttaaagccatcagtagctatagtgggtgcccacctgcatgtgaaggggaggcagttctcaatttatttcaataaatccttatgatgtgccagtgaccagaaaaaaaaaaaggggggggctaaaatatcccggaggggccagagtagccggccagtttggaaaaggccccaggggggaaaaaaagccggcgttaaaggggagggaagcacggtctggcagccctgggggcatggacccacaaacgccggataaagttgtgaccatcgggaggcgataaacacg

SEQ ID NO: 289012 - DNA, 777 bp, Homo sapiens
ccggggagcaggcgctccagcagcctgcagaggaccaccccatccttcagcgacgcctgcagaaagccctccgggtccgagatggtttttttgggcgactccagcacccccagagtgatgagccacgtaacggtggcggggacaggctgaaaacgagacgtttgtttcgctttgctaccttgcaagccggtcatgacggaacagaaatgatggttccatctgaagccatatgggtctgaatcgggaggaaccgactctccggagcgcggcgccgacctcaccggcagggcaggggcctgcgcgactctgctctagacggacggtgacgcttcagaccctgccgggggaaggtcaaggaaacggcgtggcctgaagtggggctgtgcagagggccgggccgggccgggccgggcgcctggctgcgtctcggggacgccgaagatctgggctgtgaaagcagcaggccgaacctggagagcccagacggcaagtgtcgcgtcatgcgcgagcttcctcgaacaactgatgacacgcacacattgacatgcgaggaagaaatggagcctcttcttaaaaggacacgagtctccactcactccatccactgtccctgggcgctcccccagtttgctcgctatgacccgcgggcagtttaacaagcaaagcacttagtctatgccaggcacatacattaatccattcaatgacaaaggctagaaagcatataaagcttccaaaaataatcagaggcttaagtcgtctccccctgccttctgc

SEQ ID NO: 289013 - DNA, 795 bp, Homo sapiens
cctgcgcttacctgccccgggcccgccgtgcgccccgcgcccctggccggggcactcggaagcctttgtttatgttttgaattcgtgagcgttgaaatgatgaagtacttcccagaatgctctttttatttttgccggttttatttcaaggtggcggggacaggctgaaaacgagacgtttgtttcgctttgctaccttgcaagccggtcatgacggaacagaaatgatggttccatctgaagccatatgggtctgaatcgggaggaaccgactctccggagcgcggcgccgacctcaccggcagggcaggggcctgcgcgactctgctctagacggacggtgacgcttcagaccctgccgggggaaggtcaaggaaacggcgtggcctgaagtggggctgtgcagagggccgggccgggccgggccgggcgcctggctgcgtctcggggacgccgaagatctgggctgtgaaagcagcaggccgaacctggagagcccagacggcaagtgtcgcgtcatgcgcgagcttcctcgaacaactgatgacacgcacacattgacatgcgaggaagaaatggagcctcttcttaaaaggacacgagtctccactcactccatccactgtccctgggcgctcccccagtttgctcgctatgacccgcgggcagtttaacaagcaaagcacttagtctatgccaggcacatacattaatccattcaatgacaaaggctagaaagcatataaagcttccaaaaataatcagaggcttaagtcgtctccccctgccttctgc

SEQ ID NO: 289014 - DNA, 794 bp, Homo sapiens
ccgcggccgggccaggcgccgagcaggcagctgcggccctcgggaagcccggagaggggacccactccggcgccctgcccgcgtccccctttgtgggtgacagactgcacgggaggacaccggggcagctcccatgcccacgagggtgccctccctcgggaactagggaaggcagaagagcccgctgaccaccagaaaaaacacggggacggcggggacaagggctgacccgtctccaccgagactgaacctcgagttctaaggtgggactgccaagatgaatagacataatcctcgatctaaccacttcacagtttatcatcggagtcaagtttgcagataaacaattgccatgcaactttcaagaaaatggtgcctgagatgagcaaggtcagcagacaagaagtgaggtcaatgtcaggtttccatgccagcagcgggaactctggatacagtggagagtcacagctggtcaaaccctgaaccgcttgctccttgaaatggccagagaggcccatcccagagccatctcatcatctctcctcagacaggaaaccgagaaggaaaacaatcagctctgttctctctgggccgagggagtgagctgtaatgagggagcacaggaacgcattgggcgccctcagacctgaacacacaggttagcaccacctgcctggctgacctggctcacaggtgcgcggttgccagttgagaataactcatccagggttgttgaatggtggaggatcttccaaaatcagcagctaggaggtcgagaacccttcatgccatac

SEQ ID NO: 289015 - DNA, 407 bp, Homo sapiens
ctaccacccagcagtgtgccaggcaggtgtcgtcagcctcgaagtccctcacgtactcgaacttgctttttgccatggtcgcccccaatctcaggtaccgtctcagagtgatggaaatggtggccaaggaatcgtgaaccttaactttacaggcgccccacattctacacgcggaaaggaaagggccagatagccccgccccggaagtgttctcttcgtggctactctagccgtagggcggtcatagtctctctcgcctctccctgtagttcttaacctcccagggaaagaggatggaggtttaggttcctccgttagcaccttccacgcttgcttcttcctcctcccgtcctgcggcaaatcagtctcacgaggtttttaaaaattattttttatctgctggtctt

SEQ ID NO: 289016 - DNA, 830 bp, Homo sapiens
aacatccattttcaaaattctctaggcaaacaacacattcagtacagtgcagcatatcagcaggccaagttaaccaatcaggttccatatcttcattagtgttatatgatccatatgacctccccttcctttcacatgggctggtctgacaatatttattggcacatgaacaagcctcagcatcacagtgacttgctgttcctggagaattgtgaagtacgctttgcttatcttcaaatacttccttctcactactcaaagtgtctgtgttctcactttccgagtcattttcagtatcttgagacccctccgacatttcctcttcagactggactccaagacatttaaatcgccacattgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctccccttaccctcagtttcactttctgcagtcaactgcagtccgaaaatactacatacaattagatattcggagagagagacaccacatttacataaatgttatttcagtatactgttataattgttctatttttattagttgttgttgttactgtgcctaacttacacattaaactttatcacaggtatgtatgtataggaaaaaacatagactatataggatttggtactatccacggtttcaggcatccactgggggtcttggaacgcatccccctcagataaggggggactactgtaaacagaaaataaca

SEQ ID NO: 289017 - DNA, 718 bp, Homo sapiens
ttattttaccaaggagcaaaactgagtaagtttcctgacgaaaataatgagtgtctactgttctagggcctttaacaacaacaacaacaaatttacattaacgcacattatgtgccaggaattgcaagatgcataagattagtttttaaaatgtgcctgctagagctgaacaggtaacgagagttcgaagccgggtccagagctatcttctgtaacattcttctgggtcgagtccctgccccgctacgagactatacgtaacatggacctggaaaagcttaaaaatatgaagaggattgaactggctgccatctgtgcatcttcatttatgaaaacactcctcatagacttaaaacaaatgacagagaacaaattagtcagcttcttctaaaatacagtggtctccccttaccctcagtttcactttctgcagtcaactgcagtccgaaaatactacatacaattagatattcggagagagagacaccacatttacataaatgttatttcagtatactgttataattgttctatttttattagttgttgttgttactgtgcctaacttacacattaaactttatcacaggtatgtatgtataggaaaaaacatagactatataggatttggtactatccacggtttcaggcatccactgggggtcttggaacgcatccccctcagataaggggggactactgtaaacagaaaataaca

SEQ ID NO: 289018 - DNA, 958 bp, Homo sapiens
tgcagtttaaaaaatgtatttttattggtacatagtaattttacatattcatggggtagatatgatatttcaatatatgcatacaatgtgtaatgatcaaatcagggtatttagaatatgacatccaacatgtatcatttctttgtgttataatcttcatatgcaataatcaataatcataaacaggatttctagttctcaaacgggcatggaatcattacaaaatgttattagttgtaataggtgaggcttctaatgaatgaggaatttcctaatctctctcaaccacagattattatgaaatggagtacaggcttccacctccatcactgacactccttcttttggtgaaccacaagaagattggcattctggttgtgagccctgcccatcacaggagatctggcaaccaaaaaacagcaacgcaaagggaccgagacgcccctcttgtatgaggtcttgtcatgccaagtgtatgggatttggagtcagcctggtcacagtttgaacccttgttacaccattttgagactgcggacctcagagaatctgtttcctcttctgtaaaatgaggagtggtcttgggcatcatgaaatcattcgaccccaaactgtctccccggcaggagtttgttttgctttcttgaaatcggccatcattcaattcctctgccagagtccatgttagcctgagaccaactggaaattttttgcctctgagaaaggaaaccagagagactcctccgtgagctccggaggaagagacgccagccttctgacttctcaaagcatgttattcgcatcactacctactcaggccacacgggggagccgcgggccgggcaaaggcgagtccgcgcgcccgcccagcgcacacctgcccggcggtggcggatgccggctgcgggctcccagcgtgggccaagagtcctcactcggcgagttacactgaaatcaa

SEQ ID NO: 289019 - DNA, 484 bp, Homo sapiens
tttttttgcagtttaaaaaatgtatttttattggtacatagtaattttacatattcatggggtagatatgatatttcaatatatgcatacaatgtgtaatgatcaaatcagggtatttagaatatgacatccaacatgtatcatttctttgtgttataatcttcatatgcaataatcaataatcataaacaggatttctagttctcaaacgggcatggaatcattacaaaatgttattagttgtaataggtgaggcttctaatgaatgaggaatttcctaatctctctcaaccacagattattatgaaatggagtacaggcttccacctccatcactgacactccttcttttggtgaaccacaagaagattggcattctggttgtgagccctgcccatcacaggagatctggcaaccaaaaaacaggtactatttgtactgcctactgtctcccatcactatctgctataagtaagaactaaaa

SEQ ID NO: 289020 - DNA, 746 bp, Homo sapiens
cggacgcgtgggtcgacccacgcgtccggagaccccaagacatgacaacatggaagcctcacctcggataccgtttctgattattatgaaatggagtacaggcttccacctccatcactgacactccttcttttggtgaaccacaagaagattggcattctggttgtgagccctgcccatcacaggagatctggcaaccaaaaaacagcaacgcaaagggaccgagacgcccctcttgtatgaggtcttgtcatgccaagtgtatgggatttggagtcagcctggtcacagtttgaacccttgttacaccattttgagactgcggacctcagagaatctgtttcctcttctgtaaaatgaggagtggtcttgggcatcatgaaatcattcgaccccaaactgtctccccggcaggagtttgttttgctttcttgaaatcggccatcattcaattcctctgccagagtccatgttagcctgagaccaactggaaattttttgcctctgagaaaggaaaccagagagactcctccgtgagctccggaggaagagacgccagccttctgacttctcaaagcatgttattcgcatcactacctactcaggccacacgggggagccgcgggccgggcaaaggcgagtccgcgcgcccgcccagcgcacacctgcccggcggtggcggatgccggctgcgggctcccagcgtgggccaagagtcctcactcggcgagttacactgaaatcaa

SEQ ID NO: 289021 - DNA, 628 bp, Homo sapiens
gcaatacttactatatgcatattcatctctctaacaataattctttacactgtaggcttgagttttgtgggttttttttttttctcattccagagtgaaaggaataaaattcgtgatgtgagatttttacaaaagcagagtggaagaagccaaaagttataaatcctccatcgcagtcctagttaaatatattgctgctaggctctagacagaattacaagatgttcacaatttgtctcattttccctttcagatcgccaaactttggcatcagagcaaggtccacacttatcactgaaaattttcccacccagccccattaaaaacgttaaagtgtgagagattttatttcaacactgacaagctagttactagagggcctacaaaggtaagtaacaagtttccatttcaacttgagagacaaatgatgttaaaatataagaagcagggtaagtcaggtttgtgattttaaataaaagggagaaggatttcagactgaggaatgacaggttagtatggctaaagattgaggtgtgataaatgggagccaaagtgcacagcaaaaatatcttgactaatccatatcctccctgtcttctatcatgtaaccaaggaaggagaccacctg

SEQ ID NO: 289022 - DNA, 1388 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 289023 - DNA, 1245 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaagtaactttatgtaaaataaaccatcttcaaaagagaaaaaaacccaaacaaaaaaaaaaaaaaaacaaaaaaaaacacgcaaaacaacaacaaaaaaaaaaaaaacaaaacaaaacaaaccaaacaaacacaaccaaacacaaaacagacacaaaacaacaaacacaaaaccaaacaaaaacaacaaaaacaaacaaaaaaccacaacggggggggcgcgccaaactataaccctccgccagacggagcgacaacactaccaagccgcccacccctcgactagctaacagaggcacgcgccccccctcgaatcgggggcgtctacaatctacgacgagcgcgcggccaccgctcccaaaccaccccccccgcacgcgacaccaccccacacggccctcccctgtggcaccacacaccccccctcccgtggcgggaaccactgcccacgcacccccacgccagaatagtaccgcgcccaggaaaaacacaccgcgccgtcatctggcggccacacccccaccccatactgcgcgcgcgcgaagaaacccaccccccgctgagcctgacaccacacaacaaaaggcggggcccaccctcatacccaccgccccccccccgcccaccccgacaaggcaagcaaccccacccgccgcagcgcaccccgccccccgctcgagcagtccaccacgcccgacacagcacacgccacaccccgcacgcatcccacgccgcaccccccaccagcagacgagccacacagaacacgacagcacacccacaacaccgcacccgcacgtcgctctgacgccgcgccagcgccact

SEQ ID NO: 289024 - DNA, 729 bp, Homo sapiens
tcaatctccaatcctagcactccctaatgccatgccttacacctggctctattcacatgtacatgcaccttcctggtttctctgtatatgaactgaattactaataagtttagtttaaaactgactcagtacctgaaaatctgttcaatcatgaaaatttaacttgattaagaaaggcagggtcctagaaattataaaataccctcattcgtaattttgtaatcacaatttattttattaacaaggcccaaatgaggcacagatattcacactgaatgaagtgtaacaccgaatccacgtcttttattcctagaaaagaagacttttcagtctacttatttaacctggtcagaactgtgtcatcgtcttgcttcacgccccacatagtagcagcaaagtaaaaaagctaaggaggcaacagaatgtcatggcagtcagatgtgatagctttaaaaggatatgaaaagcaagacagaccctaaaaaatgatggaagtagtctaaaagccacaataatgtatgctttggtgtaaactatttagtgtaagaataaatggttttaattacaaacaaaaatatgttttttgtttaggaaggcagacaaaaatttgcaggctttttgtctttttagttttggatagaaaatctttctaaagattgctgcttaaatgggttaactcagctatatcaactagaagtcttaaaaaaagtacctgaaaactatatacat

SEQ ID NO: 289025 - DNA, 1727 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttttctttagttacccgaaaacatt

SEQ ID NO: 289026 - DNA, 1947 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggtatgttttactccaaagatgaactctaagttatttttgttatacattctggtgtgactatactgttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 289027 - DNA, 2286 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggtatgttttactccaaagatgaactctaagttatttttgttatacattctggtgtgactatactgttaagatttattctccaagagtacaggcattatagagttgtgggttttttcattttttgcatacttccttacgtacagtactgttgtccattattaaagggatttttctctcttctgtctttatttaatgaagaatccttcctgtgttcatagaaagcagaagcaatatgtatacatactacatttttgctttttttcttattctccaaggatttttcccttacccccttttaaaaaaaattttctatctgtcaagtcaaataagtgaataatcagaggcaaaaggtcacagccataacctttattcctcactggaggagtctggtgagaccatgccaacattactaacagtgaactattacaaaatttcctggtttatcttttgtaatccacatgggtaaaaggaggagaacattttcttaaagggaggtaagaggtaaacaatactggttatgcttcagtgttatccttaccacactttttttccttcttaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaatagcacctgttttgaatattcttattccatcgtgactaatatcaaattaaagctgcaactcatttgcctaattttttaagcaaaatatgataggcaaacctatgctttttttaaaaaaggcaccacaaaaaacaaaacttagtagccagctttaaaagtgttaaggaatgtgttttgccctctagaaacctttataaatggctttttgaatgccatcctgatatatttagctatttgtccattactattaaactgcagaaggtatttcaactgttacatggtactgaaagccagtcgtctgggtaatgaatattatttttctttagttacccgaaaacatt

SEQ ID NO: 289028 - DNA, 1719 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggagatcgccaaactttggcatcagagcaaggtccacacttatcactgaaaattttcccacccagccccattaaaaacgttaaagtgtgagagattttatttcaacactgacaagctagttactagagggcctacaaagaaaagaagacttttcagtctacttatttaacctggtcagaactgtgtcatcgtcttgcttcacgccccacatagtagcagcaaagtaaaaaagctaaggaggcaacagaatgtcatggcagtcagatgtgatagctttaaaaggatatgaaaagcaagacagaccctaaaaaatgatggaagtagtctaaaagccacaataatgtatgctttggtgtaaactatttagtgtaagaataaatggttttaattacaaacaaaaatatgttttttgtttaggaaggcagacaaaaatttgcaggctttttgtctttttagttttggatagaaaatctttctaaagattgctgcttaaatgggttaactcagctatatcaactagaagtcttaaaaaaagtacctgaaaactatatacat

SEQ ID NO: 289029 - DNA, 1320 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 289030 - DNA, 1224 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 289031 - DNA, 1631 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagttgcccggtcactaaattctgagcagctgcgggagctcttctggctcccaggacaatctcgctccgtcgtttctctgcctctgcggcgcggagtgcgtttttctatcaaaataagcgagcaccttgccaggttccgtgggtacaaagacgaacaacgccatccccgtcgtcgaatggcagacaagtaaccagtctttgtaacgtagtgaagaagagagttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 289032 - DNA, 1208 bp, Homo sapiens
acgtctcagtgggcgccctaacgaacccgggatacggtctgttcctagtccgctccggaaatgcaactgcgtacgggctggccgcgtaatcgtgacgacagcgcgccagcgccggctagccggacgccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggttcttccgaatgatccagtctttcttgagcctcatgaagaaatgacactctgcaaatactatgagaaaaggttattggaattctgttcggtgtttaagccagcaatgccaagatctgttgtgggtacggcttgtatgtatttcaaacgtttttatcttaataactcagtaatggaatatcaccccaggataataataccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 289033 - DNA, 1366 bp, Homo sapiens
  misc_feature (165)..(165): n is a, c, g, or t
  misc_feature (212)..(212): n is a, c, g, or t
ggcgacatctccggtgggggtactggtgtttgtacgccacggatcgctagatgcagttatgtggttgctccgatccgtgcgatactccatctaggtaaccgtggttcgatcgaatctgccattacgatgctagctcaaccagatgatgttgagtttcagaacagncgggacaactggcgaaccatatctaccaatgacgcagagagacacgnctgtgactagacgtacctgcagggactgacggtccagaccgacatacacttcaagaatgcatagaagtccgcgatggtccatagcaggcgcgaggttcttccgaatgatccagtctttcttgagcctcatgaagaaatgacactctgcaaatactatgagaaaaggttattggaattctgttcggtgtttaagccagcaatgccaagatctgttgtggtacggctatgatatgctcatttcaaagcgttggttgtatcgttaacaatagagcatcatgtcaatgggagatagtcaccccgatgtgatggataaatgctcacttgtgcatttttggcctgcaaagtagatgaattcaatgtatctagtcctcagtttgttggaaacctccgggagagtcctcttggacaggagaaggcacttgaacagatactggaatatgaactacttcttatacagcaacttaatttccaccttattgtccacaatccttacagaccatttgagggcttcctcatcgacttaaagacccgctatcccatattggagaatccagagattttgaggaaaacagctgatgactttcttaatagaattgcattgacggatgcttaccttttatacacaccttcccaaattgccctgactgccattttatctagtgcctccagggctggaattactatggaaagttatttatcagagagtctgatgctgaaagagaacagaacttgcctgtcacagttactagatataatgaaaagcatgagaaacttagtaaagaagtatgaaccacccagatctgaagaagttgctgttctgaaacagaagttggagcgatgtcattctgctgagcttgcacttaacgtaatcacgaagaagaggaaaggctatgaagatgatgattacgtctcaaagaaatccaaacatgaggaggaagaatggactgatgacgacctggtagaatctctctaaccatttgaagttgatttctcaatgctaactaatcaagagaagtaggaagcatatcaaacgtttaactttatttaaaaagtataatgtgaaaacataaaatatattaaaacttttctattgttttctttccctttcacagtaactttatgtaaaataaaccatcttcaaaagagctagaata

SEQ ID NO: 289034 - DNA, 340 bp, Homo sapiens
gacgccaaccgcaaattcagatgcaaagccgtggccaacgggaaggtgaggttttcccaacggttgcccagttgcccggtcactaaattctgagcagctgcgggagctcttctggctcccaggacaatctcgctccgtcgtttctctgcctctgcggcgcggagtgcgtttttctatcaaaataagcgagcaccttgccaggttccgtgggtacaaagacgaacaacgccatccccgtcgtcgaatggcagacaagtaaccagtctttgtaacgtagtgaagaagagagtaagtagtgtgctaaggtagtgcgtggcaagagccgttcacttgtcaagag

SEQ ID NO: 289035 - DNA, 139 bp, Homo sapiens
tcatcacgcgcatcctaggtgaggaaagggggcacggtgccgagagggtgtggaggagaaggaaggaggagcggagggatgaggtgcggggtgagcggtgcgacgctggccccagacaggagtggacatcgctgctggg

SEQ ID NO: 289036 - DNA, 749 bp, Homo sapiens
ctccctcaggcatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaagacaggcaattcagtaggtcaaatggcaaaggtaaaaccacagtggaaggcttctctgtggacagagactgaagggtgtggaggtatcgaagctgaacggcagcaggggtgcctgacagaatctcagctgccatcctcagggactcagaagcagccttttccgcttctgcagcaatcatctagaaaacatgtgacgaaagcaaagtgattgttcttcattccctgaaggcttcaccactatgcagtatgactcagcagacaagcactgagcatctactatgtggcaagcacgcctccacagccagtgagtgctgaagcccagctggcaacctcacatctttactgaaaaagaaagaatgcaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattga

SEQ ID NO: 289037 - DNA, 488 bp, Homo sapiens
ctccctcaggcatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaagacaggcaattcagtaggtcaaatggcaaagcctccacagccagtgagtgctgaagcccagctggcaacctcacatctttactgaaaaagaaagaatgcaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattga

SEQ ID NO: 289038 - DNA, 822 bp, Homo sapiens
cagcgttgatctgtgagcagctgtgccgtaacacactgagcactagacagtccgacgtagtcataaacaagagagaaagatgaagagggctggggcgtgatgtcagctcgagtgagtgcagctcattgagaggatgacgatcgatctccgtgtaaggattgtcagggccaaggattgtatcatcagtccaggtataatccgacattgggactcgctctcgtccccgttcagaggtcataacccgattgcagcatgctagttagtctctaggtgggacacgccgtgtcgcctcgaacgagggtgacctaggacccaggttgtctttcccggaacgagtgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattga

SEQ ID NO: 289039 - DNA, 339 bp, Homo sapiens
gcctggcctaaaatgggaaatttcatgtaaattttatctaaaacaatttttagattcatagagaaaaaaataatcagagtaatttgtccaaatgttatagtgattgtgttatggctgtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattga

SEQ ID NO: 289040 - DNA, 428 bp, Homo sapiens
gttttgtattgatgagctgtgctcagtttttccgcttaggatataatctaagccccaactaataaatttgaacaatggcttgaagagccacactactgataataaagataaggggaattcatccaagtttataaaagagaagaattgattttgaaaagggtacaactgaccaaataagaacaacgcttaatgtattgcataaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattga

SEQ ID NO: 289041 - DNA, 880 bp, Homo sapiens
accaatactccagctatttgagcagttgttgcaaagggatggtaacagcaatggctctgagtaaatccactaactcacacaaaaatgctactgaagacctttatgaggtggataagttgaaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattga

SEQ ID NO: 289042 - DNA, 740 bp, Homo sapiens
ggaagggcagggaatgaggacagagtgtctccctcaggcatgtgacttttctatggcaggcccctttacagtcacattatgccccatccttcctataacatgggagagtctttctttttaggatttagtggctcaacaggtttggaaggacttgggaaggggaggcttccctgagttctgttgctgggagaagacaggcaattcagtaggtcaaatggcaaaggtaaaaccacagtggaaggcttctctgtggacagagactgaagggtgtggaggtatcgaagctgaacggcagcaggggtgcctgacagaatctcagctgccatcctcagggactcagaagcagccttttccgcttctgcagcaatcatctagaaaacatgtgacgaaagcaaagtgattgttcttcattccctgaaggcttcaccactatgcagtatgactcagcagacaagcactgagcatctactatgtggcaagcacggttaagcatagaacatgtttattcttctttctgaagggtcttgagctggggagacagattaaactgttaatcacaatttaaggtggaatgcgttaggagccatcacaagtataaatgaagtattaggggagttattagcatctggtgggccttgaaagattaggattttgccaacatagagaaaagattagccagcattccatgcaaaggcatgacgttatgaaagggtgacccccaactcagggaaagtgaatgg

SEQ ID NO: 289043 - DNA, 693 bp, Homo sapiens
ttactaagaagtgataaatatattcttaaatagcagcatgatttctactctgacattagcattcagagtcgctcctgggcccccagttctcagttaatcattgatgctgttgcttcccttatttctacccttcagacacattcatctaatctcactgcctttttagaaaatgagtttcgaaatcaaaaatactttttcaaccctttctattttgttgtgtcttctcttccatatcagggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattga

SEQ ID NO: 289044 - DNA, 3032 bp, Homo sapiens
gtggcggcaaccggcacctcagtccccgccgcgcttctcctcgccgcccacgccgtggggtcaggaacgcggcgtctggcgctgcagacgcccgctgagttgcagaagcccacggagcggcgcccggcgcgccacggcccgtagcagtccggtgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 289045 - DNA, 683 bp, Homo sapiens
tcccctccccagggtccctgttaatttctgtccttggtgctcaggcctgtccacagcctcccttgtctatgtctctatccagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtcttaccaaattcgccctttaacagcttgctctggcaaccccataaatgacacctgagctccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaa

SEQ ID NO: 289046 - DNA, 3264 bp, Homo sapiens
  misc_feature (2426)..(2426): n is a, c, g, or t
ggcgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccaatgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcacctggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctcagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaagcatcgaggncatttctgctgcaacaaggtttcctgtctcttcactggtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagatggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtcttaccaaattcgccctttaacagcttgctctggcaaccccataaatgacacctgagctccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaa

SEQ ID NO: 289047 - DNA, 3341 bp, Homo sapiens
  misc_feature (2503)..(2503): n is a, c, g, or t
ggcgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccagctgggccgataaaagaaatatacacaagcctcgctgacgggagagtctgtcctgctgatgcccgaagaactgcccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccaatgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcacctggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctcagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaagcatcgaggncatttctgctgcaacaaggtttcctgtctcttcactggtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagatggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtcttaccaaattcgccctttaacagcttgctctggcaaccccataaatgacacctgagctccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaa

SEQ ID NO: 289048 - DNA, 2628 bp, Homo sapiens
  misc_feature (1790)..(1790): n is a, c, g, or t
ctttcccatggtcacacagtggtgacaggtggagcccgcccacacccagtcttctgatgccactcctttgcagaggctgtatgtccttctctgtccccgcccctgtgtcctcctcctgcccaccagaaccttctctgggatctccccctagtttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccaatgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcacctggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctcagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaagcatcgaggncatttctgctgcaacaaggtttcctgtctcttcactggtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagatggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtcttaccaaattcgccctttaacagcttgctctggcaaccccataaatgacacctgagctccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaa

SEQ ID NO: 289049 - DNA, 2711 bp, Homo sapiens
  misc_feature (1873)..(1873): n is a, c, g, or t
ctttcccatggtcacacagtggtgacaggtggagcccgcccacacccagtcttctgatgccactcctttgcagaggctgtatgtccttctctgtccccgcccctgtgtcctcctcctgcccaccagaaccttctctgggatctccccctagtttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcaggttctcagcctgggcccaaagaatatgcaggctcctataaaggaaggaaagttctcccactttgaaaatacgtgtcattcaaaggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccaatgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcacctggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctcagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaagcatcgaggncatttctgctgcaacaaggtttcctgtctcttcactggtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagatggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtcttaccaaattcgccctttaacagcttgctctggcaaccccataaatgacacctgagctccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaa

SEQ ID NO: 289050 - DNA, 768 bp, Homo sapiens
cctagcctttgactgcagcaggagggaaggagaatattttgggagtaggagaaactgtggaggactcctctggaaactgatgtacaaagacttcctgcccggtcctgtagcttcttcaggccctgggacccagggcatctgcttggctctgtctggggaacagctcaggtggaaggggtggggtgaggtgcaaactccccacccagataagccctccctctgggcagagctgcaggtggagtgaggtcctcagcgtgccctgacctcggctccaccgagatgtgcatgtgtatggacttcctttctccactggggataagaagactgccccaagttggtggtttaggagaatcccaggggacctggcaccaggatgcagagcccctagctctcattcccccaactcccaagcaggtggatggagagacgatggagggtgggggctgcacccaactgccaggcctaagcccatcttctccctctgcccccagctcacccgagaattcttcaccaaggagctcaccaagcactaccagggcaataacgacacagacgtcttctctgccacctggaactcggtcatgatcacagtgagtgacgccccagagatgctatgaacattcagagccacgatgcccagtgttcacatgcccacgccaggcatcagtaatcaatccaggcactctcccattgatcacagacctggccttggaatcaccatccacgcagcattccaggcagccatgccacttgatcacagtccctact

SEQ ID NO: 289051 - DNA, 398 bp, Homo sapiens
ggtttctcttgctcacgggcctctgcattccttaggggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggtaatgccactgttccagcgcctaattaagccacgagctctttctcccctttccccagcctgctgccctccgaggccgagctcccagactaacacagtggagacggagctcacggcaccctagggccatccttcctgtgt

SEQ ID NO: 289052 - DNA, 6376 bp, Homo sapiens
  misc_feature (1530)..(1530): n is a, c, g, or t
  misc_feature (3476)..(3476): n is a, c, g, or t
  misc_feature (3573)..(3573): n is a, c, g, or t
tcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacacnatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccangggatcgcgaggtcatgtatctgcaaaatgcacctttttaaagagtgtcttagttccccagccccagctaatacccggccaatgccgtgtacgcacnggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccaggggacactctcccagacagccctgacccgccagcaggaccccgtcccctgctcacacagctcttcaaacttaccaaggacaggcaggaccccgtcccctgctcacacagctcttcaagcttaccaagtcccctgttgagggcacagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcctgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgaaaaaaaaaaactgtgtcggcgcagcttcttttgctctcccagcggggggggctcgccttaaatcagagcatctcttggtgaggatttgagaaggacaccgatgccctcagcccctcaggcttctctcccctggccacagcagcaccattcctttaccccaggataatgcactcatgtcccatggttaggaacccctgtcttcaataaaggagactcgggtgtgggaagataaggtaagtcttctgatgggtgagcactggcagagctgggggcagggctaggaaactgatcaccgtgtgtgtgggcctgacccgct

SEQ ID NO: 289053 - DNA, 6433 bp, Homo sapiens
  misc_feature (1530)..(1530): n is a, c, g, or t
  misc_feature (3476)..(3476): n is a, c, g, or t
  misc_feature (3573)..(3573): n is a, c, g, or t
tcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacacnatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccangggatcgcgaggtcatgtatctgcaaaatgcacctttttaaagagtgtcttagttccccagccccagctaatacccggccaatgccgtgtacgcacnggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccaggggacactctcccagacagccctgacccgccagcaggaccccgtcccctgctcacacagctcttcaagcttaccaaggacaggcagaaccccgtcccctgctcacacagctcttcaagcttaccaaggacaggcaggaccccgtcccctgctcacacagctcttcaaacttaccaagtgccctctcccctgttgagggcacagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcctgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgaaaaaaaaaaactgtgtcggcgcagcttcttttgctctcccagcggggggggctcgccttaaatcagagcatctcttggtgaggatttgagaaggacaccgatgccctcagcccctcaggcttctctcccctggccacagcagcaccattcctttaccccaggataatgcactcatgtcccatggttaggaacccctgtcttcaataaaggagactcgggtgtgggaagataaggtaagtcttctgatgggtgagcactggcagagctgggggcagggctaggaaactgatcaccgtgtgtgtgggcctgacccgct

SEQ ID NO: 289054 - DNA, 6483 bp, Homo sapiens
  misc_feature (1530)..(1530): n is a, c, g, or t
  misc_feature (3476)..(3476): n is a, c, g, or t
  misc_feature (3573)..(3573): n is a, c, g, or t
tcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacacnatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccangggatcgcgaggtcatgtatctgcaaaatgcacctttttaaagagtgtcttagttccccagccccagctaatacccggccaatgccgtgtacgcacnggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggagtgcgaggtatgggggaataggaactatgagctaaatatacttatggggtgggggccgtgggggccaggggacactctcccagacagccctgacccgccagcaggaccccgtcccctgctcacacagctcttcaaacttaccaaggacaggcaggaccccgtcccctgctcacacagctcttcaagcttaccaaggacaggcagaaccccgtcccctgctcacacagctcttcaagcttaccaaggacaggcaggaccccgtcccctgctcacacagctcttcaaacttaccaagtgccctctcccctgttgagggcacagcaaccccaggccctccctcccacctcagctgaagccccaatcttccaaatcggaaccagcaagtcttagggctggcacgcatctgggcctctagctgagaacccggactctcaggcacctcagtgcccctgccccagggcagaggcccaccccgtgggttggtgcagtggctgccctgggctccacgggcagcacagggagtctgtccaggaagcagcccagccggggtcagtattccgtggagccagtcctgagctgggaggggcatttaacacccctgagggcctggggcaggacacagctggccctcctcattgtcaggggaagcaagtgcccaacatctgtaacctcccttccctgctcagtccccaggccaaggttgggacccctctccatccctgtccccagagcctagacctcagggacctaggaaaagcctcctgctccctccccacggcagcagacagggcagggcctccagcccccagagggccggtggggggtgctctcgggccttcctgctctcctaaggttgcggggacagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgaaaaaaaaaaactgtgtcggcgcagcttcttttgctctcccagcggggggggctcgccttaaatcagagcatctcttggtgaggatttgagaaggacaccgatgccctcagcccctcaggcttctctcccctggccacagcagcaccattcctttaccccaggataatgcactcatgtcccatggttaggaacccctgtcttcaataaaggagactcgggtgtgggaagataaggtaagtcttctgatgggtgagcactggcagagctgggggcagggctaggaaactgatcaccgtgtgtgtgggcctgacccgct

SEQ ID NO: 289055 - DNA, 5620 bp, Homo sapiens
  misc_feature (1530)..(1530): n is a, c, g, or t
  misc_feature (3476)..(3476): n is a, c, g, or t
  misc_feature (3573)..(3573): n is a, c, g, or t
tcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacacnatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccccagggacattggctgtcctgaccatgtccttccccctcctcccagggcctctgcttcctcaggagctgcccagactccagaaaagcctggaaaaagggaggcgggaaggggagcactttcggctttctataggtcagtccagcagggccangggatcgcgaggtcatgtatctgcaaaatgcacctttttaaagagtgtcttagttccccagccccagctaatacccggccaatgccgtgtacgcacnggcatgtgcacgcaaacacgcatgagaaccaggccattccttccgctgtggaagcagaactggagacggggcaggaatgtgcccagcagagatggggctcagcccgaggcagggctccctcctgcatgaggctcggcccgaggcagggctccctcctgcatgagtctgtggcctccaggagggacttgggtgcagatgtaagcaagaaaaaccggggctccagaggcatgtgcatttcccctgcgcccctcagcctttaaatattccctcctcctagaaggttctagaccccccccttccagcaggggtgcccaagagtccctggaccctcaaaattgcaaaggagacccaagcggggctcgctgacctcccagggcccagcaagatgggatagccagccttaggtggccccacgagcccaagcctggggaagggcccctccccagccagacgagaggcagccaccccagagaccacaggagccgtaccatggcctgcgcagtcaggccctatcaggatgtgtctgtcccaagcctggccaggctccagtcctgtgccagtagctcactgctgtcctatgtgcaggtcccccaacacttggagcctgtggttaaggcctcctgggagaggcagtgagcatgagtcaaaggtgacatggacttgaatctccccaccccgccccgcctgcagtagccgggccaggtaggaggcaaggatcattccctgctcccagaggttccagatgacctagtttcgttttgtgtgtgtgtgtgtgtggtcacccagacgtcactgtgatatcacctagtgaatctatttctggccctgtcttcgtcggcccagtttctgtaacttgcagccaatttgccctctcccctgtggctgccagcccatctgcccctctgtgtccttgctgccctggccctcctctgttttctgtaacagatgctccagtcattgcctttcagagtggagcagatgacagatggggtgcacgcattcagacacctctgatgcccttagccagggcagggatcgtccttaaagtgaaggcctggacaggaggagtcagggacttgggaggaggtggagctgtggggatgggagtggaggaatcaaaatgagggaagctgaaaatagaatgaaaacgatgactaagaggcagggaagtagagtgctgagccccagacccagtcaccccaagatggccccactctatccactctctagacctttgggaaatctgggtccctctcctgatttgatccattcggccccaactccagagtcgggaatgggagatgaaactagttttccacccacttttggacaagtcccacccctagatctgaagcaagctctaccagcagcgtgtcctggaagcctgcctgcctgcctgcccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgaaaaaaaaaaactgtgtcggcgcagcttcttttgctctcccagcggggggggctcgccttaaatcagagcatctcttggtgaggatttgagaaggacaccgatgccctcagcccctcaggcttctctcccctggccacagcagcaccattcctttaccccaggataatgcactcatgtcccatggttaggaacccctgtcttcaataaaggagactcgggtgtgggaagataaggtaagtcttctgatgggtgagcactggcagagctgggggcagggctaggaaactgatcaccgtgtgtgtgggcctgacccgct

SEQ ID NO: 289056 - DNA, 3208 bp, Homo sapiens
  misc_feature (1530)..(1530): n is a, c, g, or t
tcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacacnatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacccgtctgcacaggtgtcttgatccagccctgcgtcttcgagcccctgtgccaccggtccccacggcccgccaggagtctctttgtacccactaggcttccctgatgaccatctgtctgtccgtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgaaaaaaaaaaactgtgtcggcgcagcttcttttgctctcccagcggggggggctcgccttaaatcagagcatctcttggtgaggatttgagaaggacaccgatgccctcagcccctcaggcttctctcccctggccacagcagcaccattcctttaccccaggataatgcactcatgtcccatggttaggaacccctgtcttcaataaaggagactcgggtgtgggaagataaggtaagtcttctgatgggtgagcactggcagagctgggggcagggctaggaaactgatcaccgtgtgtgtgggcctgacccgct

SEQ ID NO: 289057 - DNA, 3846 bp, Homo sapiens
  misc_feature (1530)..(1530): n is a, c, g, or t
tcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacacnatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtgtcaattcacaacaggcttcaaacgtcccagcacaactccgggctgggggccgagaggggagcgccggtgccgccgccagacctgcagcctagccccccgagacagcagaccccaccactgccgccgccgccacccacgcccccgggcaccctggtgcagtgccagcaaattgtcaaggtcattgtcctggacaagccctgcctggcccgcatggagcccctgctgagccaggctctctcctgctacacctcgtcgtcctctgactcctgcggctccacacccctgggcggtcccggctctccggtcaaggtcacccaccagcctccgctgcccccgcccccacccccctacaaccaccctcaccagttctgtcccccaggctccctgctgcacgggcaccgctactccagtggctcaaggagcctggtgtagactctgccccaccaccctgctgtcctgggagggctggccactggggggcctgggctgcccctccactgctccccataccctggcacgatgcgttcctggtcactgatcaccatcattttgggaagagaatcccaatccctggcacctgggtttgcctcatccaaccatccttccctttctcagctgcaccccctctgcagatctgaagacacacctcactctcccagggccctacacagccagacccggcgaggcctcctcttcccctggccaccactttcccccattggaccatggactgaagaaaacgagctgagggtctaacgagcttgcaggctttgagtctgttagtgcccggggcctcgggccttgggcagcagcatgaggctgggccggccggcagtggagcactagacagagtggctggctcgcagcccagaactagtgcctctgtagctgcactgaggggaggagggttggtcccacccctggagggacaggtgggaggagtgaggagggggctttttctgccacccccgcccccaagcctgaaactctcaggagtctacttcttggtccctgtttttgctgtacataactcctgctgcaccctctccccgcacacccgtcacccatgagagagagaaacctctctagggaaaggcagggtggctgcacccagcaactaatccaaatggcaaatattttgtaacaaaatagcccagaggtattttatctgttcaattcatagagttttagagattatattgaaagatgtcacttgaaaaaaaaaaactgtgtcggcgcagcttcttttgctctcccagcggggggggctcgccttaaatcagagcatctcttggtgaggatttgagaaggacaccgatgccctcagcccctcaggcttctctcccctggccacagcagcaccattcctttaccccaggataatgcactcatgtcccatggttaggaacccctgtcttcaataaaggagactcgggtgtgggaagataaggtaagtcttctgatgggtgagcactggcagagctgggggcagggctaggaaactgatcaccgtgtgtgtgggcctgacccgct

SEQ ID NO: 289058 - DNA, 2530 bp, Homo sapiens
  misc_feature (1530)..(1530): n is a, c, g, or t
tcccccggccggcagcagcctgccctggcgacggcgctgtgcccccacgcccctgccgcctccgattacgaactctcccttgacctaaagaataaacagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctggggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacacnatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggtaatgccactgttccagcgcctaattaagccacgagctctttctcccctttccccagcctgctgccctccgaggccgagctcccagactaacacagtggagacggagctcacggcaccctagggccatccttcctgtgt

SEQ ID NO: 289059 - DNA, 5293 bp, Homo sapiens
ggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289060 - DNA, 284 bp, Homo sapiens
cccttctttgtcctctggggtaaagaagggctgctcttctagaccctcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289061 - DNA, 5438 bp, Homo sapiens
ggcggccgcccccggcatgggcaccgcgccgcagggggcctgacccgccgcccgctccgcccccgcctgccatggcggcccgcgcgccccccgccgcacctgcggccgaggagccggggaacccgggcggccccccgcgcaggaagaagtcccgctccggcgcgtccggcctccgccgcgccttcagctggctgcggggcaagcggcgcaagaagaaggcggcgggggccgagggcgccgaaccggccgccccccgggccaagaaggcggaggacaaggccaagagggccaagggcaaaggccgaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289062 - DNA, 5333 bp, Homo sapiens
gcccgcggtgcccgcccgcgagtctcgctgcctccctcccggggctgcgggcccggcggccgggctggctgggccgcgcttgggttcccgcgccggctcccgcacccgcaatggggaactcacaccacaagaggaaggcccccagcggtccccgggtccgcagcttctggcggttcgggcggtcggcgaagcggccggcaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289063 - DNA, 2592 bp, Homo sapiens
ggcagagccacggcctccccagtcccctgcctcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289064 - DNA, 1365 bp, Homo sapiens
ttaggctagtaaggcggtgttaatcggacgagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289065 - DNA, 1317 bp, Homo sapiens
cctcctctgtgctgtaagggagcctactagggtgtagaataggaagtatgtgcctgtgttcaggcgttctggctggttgcctcctctgtgctgtcggacagcacagaggagggcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289066 - DNA, 1170 bp, Homo sapiens
ggatccccgatcgatgaaaggacctaccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289067 - DNA, 926 bp, Homo sapiens
aaataaaggcataggtagagcccgcgtgttaatcaggacgaggctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 289068 - DNA, 5186 bp, Homo sapiens
ggcggccgcccccggcatgggcaccgcgccgcagggggcctgacccgccgcccgctccgcccccgcctgccatggcggcccgcgcgccccccgccgcacctgcggccgaggagccggggaacccgggcggccccccgcgcaggaagaagtcccgctccggcgcgtccggcctccgccgcgccttcagctggctgcggggcaagcggcgcaagaagaaggcggcgggggccgagggcgccgaaccggccgccccccgggccaagaaggcggaggacaaggccaagagggccaagggcaaaggccgaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccaggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttcctgcgacctatgaagggatcctctaggtcacctcgca

SEQ ID NO: 289069 - DNA, 4530 bp, Homo sapiens
ggcggccgcccccggcatgggcaccgcgccgcagggggcctgacccgccgcccgctccgcccccgcctgccatggcggcccgcgcgccccccgccgcacctgcggccgaggagccggggaacccgggcggccccccgcgcaggaagaagtcccgctccggcgcgtccggcctccgccgcgccttcagctggctgcggggcaagcggcgcaagaagaaggcggcgggggccgagggcgccgaaccggccgccccccgggccaagaaggcggaggacaaggccaagagggccaagggcaaaggccgaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcttgtgctgtcagcacagaggaggcctaaaagcggccaccaattaagaaagcgttcaagctcaacacccactaccgataaaaatcccaaacatataactgaactcctcacacccaattggaccaatctatcaccctatagaagaactaatgttagtataagtaacatgaaacattctcgggtcctctgag

SEQ ID NO: 289070 - DNA, 315 bp, Homo sapiens
aaatcaaagcggtaagaaggttgggtgagggtatgctttgttgggctcctagtgccagaaccaagccaggaggccccttgctaagtgtctcttatttttctcccccagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcct

SEQ ID NO: 289071 - DNA, 184 bp, Homo sapiens
caggatggctttagccaccggcggagtctcccctccagcctcggggtggatggttcccatggccgcatctgcctgactcagggatcaaggccacttttccctgaaatcatctccccagggcctttggagcgctcgttcccaccgcaattaccccgctctcgggggaatcctgctgacagggctg

SEQ ID NO: 289072 - DNA, 379 bp, Homo sapiens
acagggcagcggagatccggtaaggagggtctcagccattcagtgtgggcgctgccaagtcgggggccaagacccagacgcatcattctgtgacacggccctggtggcccatctcagaagcgaaactcatggaaacatgcaagaggcttcggatgttgtggaatccagtcatatgccctaaagcatacaaaatatctgttaggggctcagaatagcacagttatgatacaaaaatggattttctctctcttttaataatgttaagaagacatcacatacctgactccaccggtgtcccagaaacggtttttaagtaacctttcctgttgaagggtagcaagtattcagaaaagtgtacaggttggtcttcttgaagcaa

SEQ ID NO: 289073 - DNA, 341 bp, Homo sapiens
gttgcaggcaaattaaggtttgggcagttacgttctgtgagcctgacttatccgattcatatatttttagggtgatgtttgccttggaaaaattatccagatatttgccgtatcttctttttaaggtaaggaaacaagtgggagaagatgccaggataacgcagctggaagcgacagtgctgtgttagaacccaggcctatcagactctaggatccagcctcgaccactccctgatacactacatggcttcgttgtacttacttggcagaggtatgggtttttggtggatttgtctgcaagaaagaatttcagataattaaaggacaaagcacaaaatgag

SEQ ID NO: 289074 - DNA, 632 bp, Homo sapiens
gttgcaggcaaattaaggtttgggcagttacgttctgtgagcctgacttatccgattcatatatttttagggtgatgtttgccttggaaaaattatccagatatttgccgtatcttctttttaaggtaccttttgtagacatattttgtgatctttaaaatatattttgacttaatttaaatcggtattatttgtttagaaccaaacactatagctggtgcttcccatatgttgttttacttgatcttattattttgaaaacagctgtattgtttttgtaaaaaaaaaaaaagttaaaaaaggatgcatgatcagtaaaatattaaatcgctactaaaaaaagtaaaaattgcctcaaatatatttacttttcaaaacaactctgtgaaataaacattcttggccccattttacaggtaaggaaacaagtgggagaagatgccaggataacgcagctggaagcgacagtgctgtgttagaacccaggcctatcagactctaggatccagcctcgaccactccctgatacactacatggcttcgttgtacttacttggcagaggtatgggtttttggtggatttgtctgcaagaaagaatttcagataattaaaggacaaagcacaaaatgag

SEQ ID NO: 289075 - DNA, 286 bp, Homo sapiens
cttttcaaggcttcctgatccctgtgcataataagtttacttcactgcttacaaacactgagaagtcaccagatctttctcagtatggatcaaatcagtcatctgacctagaaggggaagaaggttatcaaatactcatatccttcaacacaagtatgttaagaataagaatgattgagactgtttcattctatgagacaatttaactggcatgaatcagatatgctggagactatcttttcttcctttttaccagataaaccaaaataaagccaaaaacttttct

SEQ ID NO: 289076 - DNA, 274 bp, Homo sapiens
ggtagagctggtcattgggcaacagagtctgcttgtctgaagctgcacaaaaaagaaacagaatccacacaagtcccccaggattcctggggaagcccatgtagtctaactaccaggaagtatctggaacagaaggaagactagatactcttcatgctccactgcgctccagttctcactgctgctcaccttatgatcacctctgtctccccaaccccttcattcaactcagtgctgaattgcttgaatccatggagcccacccaaaggtaaac

SEQ ID NO: 289077 - DNA, 4239 bp, Homo sapiens
attcggctcgagttcacctggtgctgctttgacttcaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgtggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtaggacaggagggacatcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcataagcccacatatgctgtgacgctggccaccttttctcagcttctgaggctgcgatgcctcaggaactccagtttacagagaccagtgtgtttacttgtaaataaagcctctgggtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttactaaaataaaaagcttttacaatagctggcctgtggcctcctccagcccaccccag

SEQ ID NO: 289078 - DNA, 1766 bp, Homo sapiens
tctctgaatgctgagttctgccttaaaacagcacgggtcatgctagatgaaagggatctctgttttatactctcatctcttcgctattgccgtgggatgaaagacagcagaaggaaggcgtctaagttcagaacaaagtgagcaagaccagctggctgctgttggtagcagaggcacagccagcctgtcatggcactggggggccgaggtgagctgtgccccctcctcctgggcttgtgaccctctgccccccatgggagtttcactctggctcctaggctggaatgcggtggcaccatctcagctctctgcaacctccacttcccaggttcaagcgattctcctgcctcaccctcctgagtagctgggactacaggcgagcaccaccacagccggctaatttttctatttctagtagaaatggggtttcaccatgttggcaggctggtctcgaactctgacctcaagtgatctgcctgcctcagcctctgaaagtgctggattgcaggcgtgagccaccgcaccaggcctaaacagatttctttacaatctaccaccatgaacagcaagcattagcattgctccgtcccacccagcagcccgcagagaaaggaggcagctggcaccacactgggctttggagacactgcggggactgtggaccccaccctgctgcacggagctcctgcaaaagcaaacctgagaaccttgcatacagatccctgcaagaggcatctgtctccagtggtccagcctctccttccaaatgaaaagaatcaagtcacaggaattcatgggtctgtaaggaatcgctcccatctgtgcccaggagattaacaaaggcggtggctgcagctctgtgagcagtggagaaaaattaggcacaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtaggacaggagggacatcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcataagcccacatatgctgtgacgctggccaccttttctcagcttctgaggctgcgatgcctcaggaactccagtttacagagaccagtgtgtttacttgtaaataaagcctctgggtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttactaaaataaaaagcttttacaatagctggcctgtggcctcctccagcccaccccag

SEQ ID NO: 289079 - DNA, 1632 bp, Homo sapiens
  misc_feature (1540)..(1540): n is a, c, g, or t
gtccagaggaaggaggccagcaggacctggtgggatagtccctggaaggccagggccctgcacacagactgcaagtcaacacaggagctttgctgtctgaacagccccggtcccgcgttcccagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggtgagccgtgcgaggcccctcctgtcccccgggctcctcatggggacagtggcagcgggtggggtgacccaggcagacttcacctcccccagacgatgcagatccactctgggctgggcctctgctctttcctgggctgacgtaaagcgttctgctcatttatagatgagagtcgtgccgtgcagaacccagcatgtcacccgtggtgctgctgccatgcggcgcttctgaccaggggtntttgcatgaggccccttgacagggctgctctgggtggtcactttgggtgtgtacagtaaaatacacgtgacataaaattcactattttaacc

SEQ ID NO: 289080 - DNA, 4764 bp, Homo sapiens
tctctgaatgctgagttctgccttaaaacagcacgggtcatgctagatgaaagggatctctgttttatactctcatctcttcgctattgccgtgggatgaaagacagcagaaggaaggcgtctaagttcagaacaaagtgagcaagaccagctggctgctgttggtagcagaggcacagccagcctgtcatggcactggggggccgaggtgagctgtgccccctcctcctgggcttgtgaccctctgccccccatgggagtttcactctggctcctaggctggaatgcggtggcaccatctcagctctctgcaacctccacttcccaggttcaagcgattctcctgcctcaccctcctgagtagctgggactacaggcgagcaccaccacagccggctaatttttctatttctagtagaaatggggtttcaccatgttggcaggctggtctcgaactctgacctcaagtgatctgcctgcctcagcctctgaaagtgctggattgcaggcgtgagccaccgcaccaggcctaaacagatttctttacaatctaccaccatgaacagcaagcattagcattgctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgtggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtaggacaggagggacatcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcataagcccacatatgctgtgacgctggccaccttttctcagcttctgaggctgcgatgcctcaggaactccagtttacagagaccagtgtgtttacttgtaaataaagcctctgggtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttactaaaataaaaagcttttacaatagctggcctgtggcctcctccagcccaccccag

SEQ ID NO: 289081 - DNA, 2244 bp, Homo sapiens
tacattgattgtacactttatttctattattattacactgtaatatgtaatgaaagaatcatacactgaaccataattcagaatcagtgggagccctgagcttgttttcctgcaactagacggtcccatctgggggtgatgggagacggtaacagatcatcaggaattagattctcataaggagcgtgaaacctagatccctcacttgcacagttcacgatagggctcatgctcctctgagaatctactgctgtgctgagctgacaggaggtggagctgaggccgtaatgctcactcgcccaccacgcccctcctgctgtgtgacccgggtcctgatggaccatggaccagtaccagtatgtggcccaggggttggggaaccctgctcttaaggttcccaattatcagctctgaggtagttcaagcaacagagccccttgacgatgttcagggagatagtcccgatatcctaagggggccaattagattctaatggtgttaaaacacatcttaatttttattgtaaaaatatctactctcctaagcttagaacaatattgagaagaaatgaagtggatggtggaagccctggggggtgggccttcacagtggggaaggctgtgggtggagagccagggcatcgggtaggtgaaggccagggatgccactcagcatcctgtagggcccggtatagcccgcagcagcacagaatgatcccaaggctaagaaacctctatctagaatgctcttgaatgttctagaaccgaggttctttcttttcttttcttttctttttcaagacaggaaagtgcttatcacaaagaacccccgatctcgactggggaagggttggcagttgactctctggccagcactatgtgtagcacgcatcactagaggtgtgaaggccccacagaggctctggtgtgtggctttgttttgaccaaggcgtgcaggcagtggtcctacggcagggctggcccgcgcctcgcctcagtgccctcagcgccttctgtcttctggctggattcagagtcccgggggaaagagactgaccttctcgacttgccctcaggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgtggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaaggtgaggtccaagggcggggtgggcaggggagctgtcctgggaagggtttcaggaatgcagaggagggggatgagataaaggtacagggaccgacctgagaccctgggtgaccttgtcgccgacctctgggtcccaacagcccagcaggagcccaaaactcatctcagccagttaggatccacgtgactgtgggtgaggtctcccaactccttgaatctcagtttcctcagcttgggggatgtttaatagatatttgttcgagaatgaataaatccgagctaacaacactctccacgtttgaaggcgcaaacgcgtgaaaagcagctccc

SEQ ID NO: 289082 - DNA, 2534 bp, Homo sapiens
ctcccagccccagttgaatatttgggactattcattaggtgaaccctttcgtgggtttttcagtctcgaggcaggaagccccctgagtgctaaaagcatcattaggaggaagggtgagaaatgcccccagctcctgatcaggggagaagctgtttccatcgcccttcctgtcgcctccccaccgcacagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaaggcttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgtggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaaggtgaggtccaagggcggggtgggcaggggagctgtcctgggaagggtttcaggaatgcagaggagggggatgagataaaggtacagggaccgacctgagaccctgggtgaccttgtcgccgacctctgggtcccaacagcccagcaggagcccaaaactcatctcagccagttaggatccacgtgactgtgggtgaggtctcccaactccttgaatctcagtttcctcagcttgggggatgtttaatagatatttgttcgagaatgaataaatccgagctaacaacactctccacgtttgaaggcgcaaacgcgtgaaaagcagctccc

SEQ ID NO: 289083 - DNA, 2819 bp, Homo sapiens
tacattgattgtacactttatttctattattattacactgtaatatgtaatgaaagaatcatacactgaaccataattcagaatcagtgggagccctgagcttgttttcctgcaactagacggtcccatctgggggtgatgggagacggtaacagatcatcaggaattagattctcataaggagcgtgaaacctagatccctcacttgcacagttcacgatagggctcatgctcctctgagaatctactgctgtgctgagctgacaggaggtggagctgaggccgtaatgctcactcgcccaccacgcccctcctgctgtgtgacccgggtcctgatggaccatggaccagtaccagtatgtggcccaggggttggggaaccctgctcttaaggttcccaattatcagctctgaggtagttcaagcaacagagccccttgacgatgttcagggagatagtcccgatatcctaagggggccaattagattctaatggtgttaaaacacatcttaatttttattgtaaaaatatctactctcctaagcttagaacaatattgagaagaaatgaagtggatggtggaagccctggggggtgggccttcacagtggggaaggctgtgggtggagagccagggcatcgggtaggtgaaggccagggatgccactcagcatcctgtagggcccggtatagcccgcagcagcacagaatgatcccaaggctaagaaacctctatctagaatgctcttgaatgttctagaaccgaggttctttcttttcttttcttttctttttcaagacaggaaagtgcttatcacaaagaacccccgatctcgactggggaagggttggcagttgactctctggccagcactatgtgtagcacgcatcactagaggtgtgaaggccccacagaggctctggtgtgtggctttgttttgaccaaggcgtgcaggcagtggtcctacggcagggctggcccgcgcctcgcctcagtgccctcagcgccttctgtcttctggctggattcagagtcccgggggaaagagactgaccttctcgacttgccctcaggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgtggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagtaggtgcacgctgggggctgggcaggggcttcgaagcggctcctgggctcccccaaagcccacggcaggtgcctctggagtgtgctctgcggtttgcaggaagctgaggcgctgacagggccgtttccgcacaactttgggacaagggccccgctgattgctcatgagattcccctgattttggccgggcgtggtggctcacgcctgtaatcccagcactttgggaggccagggtgggcagattgcttgaggtcagcagttcgagaccagcctggccaacatggagaaaccctgtctctattaaaaatacaaaaactagccaggtgtggcggcgggcgcctgtaatcccagctactcgggaggctgagacatgataattacttgaactgggaggtggagttgcggtgagccaagatcgcgccactgcactccagcctgggtgacagagcgagactctgtctcaacaaaacaaaacaacaacaacaacaactgctctgatttcacgcttaccaaacaaacttgatttcaaatctggcctctccagaatcttgataccaggatgacggtgccttttacagtgggcaaaagtagcctagtcactggaaaatgacattttataattgaaatttaaagttgtaaattaacaaattggcactccctcccccaagagcagctcagaggaccattgtaaggccagaaccccacccggcctcagctccactgaccctccacttactggtgcttggctagcacaatctaatccttgtcggctaaggacaaaaaaaaa

SEQ ID NO: 289084 - DNA, 433 bp, Homo sapiens
tggagggtaaccccacctgtctctcctctgcaccccttcaaaccagggcagggtctgcagcccctgcccagcctgcaggctcttgcacaagtgcagacacacctcaggctgttctcagagcatctgcgcctctgcatcactcccaggtcgccctagtgccaatcatctcccctgaattcccattcctgttgatggcttcaacagctcctcctcatcctttctctgtccctcctttagccatcttctgggggaccacagaagctggtccgcatcgtcagtatggacaaagccaaggccagccctctgcgtttgtcctttgacaggggccagttggaccccagcaggatggagggtgaggcctggtgagctggcacaggggccactggctccaagtgggtgaggggctttgggagctgctgctagttggtcagct

SEQ ID NO: 289085 - DNA, 437 bp, Homo sapiens
agaaaggctctctagtgaactggaggatatgaagcaactctctaaagagaaagatgctcatggaaaccatttagctgaagaactgggggcttctaaagtacgtgaagctcatttagaagcaagaatgcaagcagaaatcaagaaattgtcagcagaagtagaatctctcaaagaagcttatcatatggagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaagtaagtaaacatataaaagtaataaagcatatctatgaaaacataa

SEQ ID NO: 289086 - DNA, 521 bp, Homo sapiens
tgagtttatactaaagcaaagagcattagtatattagctatactaatgagtttatacttgttatacttgctataaacaattacaaagcctattctaagcatacaagtttttatatcagaataaaattgaacaacagtttaaggttattttttaggttacacatttggatatgactattcgtgagcacagaggagaaatggaacaaaaaaataattaaattagaaggtactctggagaaatcagaattggaacttaaagaatgtaacaaacagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcataca

SEQ ID NO: 289087 - DNA, 382 bp, Homo sapiens
ttagatttttttcttgaatatcagtttcacagtgggtgatactcattgtatgttaaattttaacatactcattgtatgttaaaggatttagttggaaggtggaaatttacgtattaagcaaaatcagaataagaaataggttatctatatatttcattctgaaacctacaaataccttatgcttttcaggttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactct

SEQ ID NO: 289088 - DNA, 292 bp, Homo sapiens
tttcattaattttactgatactgcttatctgtttaaaattcagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgttatgaaagagcaagaacagtacattgccactcagtacaaggaggccatagatttggggcaagaattgaggctgacccgggagcaggtgcagaactctcataca

SEQ ID NO: 289089 - DNA, 289 bp, Homo sapiens
gaaaagtcaggcgagtatcgggcttcccctagggtcccctccacctgggagaggggacgacctgtacctcctggtacctggctgttcccccagagtgaggcctttcctggaagcgttaaagctgcccaggtttcttcgtccaagcttcctacaatcaagtatgcggatcccagctttgaggaggagtctgaaattatttggaggagtgttggtgtatccttttaaggttatcgtaaaatgacagtttaaagtgtggcttcttagcgttgtttactaagttgagtgattt

SEQ ID NO: 289090 - DNA, 824 bp, Homo sapiens
agagcggccaagctggggccgctcctcggcctggcgcgggtgcccgacttaccgccgaccgcgctcacgacgactcgctcttctctatccgccggaccagctccaccagcatctctgccatcttcgcaatctccttggccttctcctcggccttctcgcacctcttggccgcccggccctcggccgcgtcgcccgggttctggaggtggttgagggcgctctcctccgaggcctccacctgcgttttgatctggatgagcatattgtccatctcccacagcttgctccggttccgcagagaagccacggacaagcgacttacgcgcagagtaacggcgaacaaaatggagtcccggccgtcaaccagcgctctgcgcgttgcggcccctttcacgacacagccgggcctctttacggtcaggggggcgagctgcgggcgcgcgcacgtctagaaagagaggcaccggcggcggcgtcgcggccgcacggacgcgcacgcaggcacgcgcaggtaaagggacacatcacagttttgactacagcagaattaaggattcagagaaacggtttcattctgttgcccaggctggagtgcagtagcatgatcacggcttactgtagccttgacctccccaggttcaggtgatcctcccacctcaccctctacagtagctgggactaaaggcacgcaccatcacacctggctaattttaaaattttttttagagattgggttttaccaagttgcccaggctggtctccaactcctgggctcaaatgatctctccccctcagcctcccaaagtgctggctgcaccaggcca

SEQ ID NO: 289091 - DNA, 1104 bp, Homo sapiens
agagcggccaagctggggccgctcctcggcctggcgcgggtgcccgacttaccgccgaccgcgctcacgacgactcgctcttctctatccgccggaccagctccaccagcatctctgccatcttcgcaatctccttggccttctcctcggccttctcgcacctcttggccgcccggccctcggccgcgtcgcccgggttctggaggtggttgagggcgctctcctccgaggcctccacctgcgttttgatctggatgagcatattgtccatctcccacagcttgctccggttccgcaggtacgcccgcccgtgctcgcgcgtcagcgacgcgatgtcctcgcgcatctcgttgatgaccgggagcagaaactgctcgaaatcctcctcgggctccagcacctccacttcctccggttccgccagctcgacgatgtccaggggccgcatctcttcccactgcctcggaaccgcaatagcgatgtctgttggagagagaaaaccgacactcgctatgcttagcaatagagagcccgaatattcctgaaaacttttaccctttttcaacttttcttctcagagaagccacggacaagcgacttacgcgcagagtaacggcgaacaaaatggagtcccggccgtcaaccagcgctctgcgcgttgcggcccctttcacgacacagccgggcctctttacggtcaggggggcgagctgcgggcgcgcgcacgtctagaaagagaggcaccggcggcggcgtcgcggccgcacggacgcgcacgcaggcacgcgcaggtaaagggacacatcacagttttgactacagcagaattaaggattcagagaaacggtttcattctgttgcccaggctggagtgcagtagcatgatcacggcttactgtagccttgacctccccaggttcaggtgatcctcccacctcaccctctacagtagctgggactaaaggcacgcaccatcacacctggctaattttaaaattttttttagagattgggttttaccaagttgcccaggctggtctccaactcctgggctcaaatgatctctccccctcagcctcccaaagtgctggctgcaccaggcca

SEQ ID NO: 289092 - DNA, 971 bp, Homo sapiens
aattacaaagttgagtaatactttatttgaaaaaatgaaaagtgcacacacacacacacacacacacacttacataggcacaggataatctggaagtatgaccagcaaatgataactgattccctcaggggagaagaaactgggtggctgaaggacaggaatgagaaagaaggacagttgcgtttgtttgtatcgtttgaaattgtccagtgtgtatgtgttcttttcaaatgtttgaagaaccattggctcccttatcaaaatgtaaataccaaggaaaatcaggaatttaagaagtctaagaattctgtaatgctgggtagaattttctgtacgtgtaaaactaaaatgtcttttgtaaatcactgagtcttcctgtttatttctggttagagatctttgggggcttggatggaggaacaggaaaagaggagccaggcttttttggaaaattggcggcagcggtggcatacgggaaactgaaatctttatctaatctcatcctttgtatattcgtcttggatttgctgaagaaaattaaaaggccaggcctaccactcctatggcacagtattgatgagagacatcagtggagctccccacctccaccccaggcttggaacttagggaatgactggtttttgtcatttcacacaacagctgaaggattctgtccccacctcgtcctctgtgaagtctgctggacgtacctgccagaatcttctgaagatgacgtttgctgaacactgacccacaggggtttgatggattattgacaatgagacaagctgtcttttcatcaattagatattccagttgtttcaggtcaatttcccaagatttctctggctggagagaaagaaaggatgagactaagatgattctgaaacatttagggggaatcctcacttatctcaagggtccaatgtaagcaataaagtctgtctctggcttcaaccaccaaaaaaaga

SEQ ID NO: 289093 - DNA, 918 bp, Homo sapiens
aattacaaagttgagtaatactttatttgaaaaaatgaaaagtgcacacacacacacacacacacacacttacataggcacaggataatctggaagtatgaccagcaaatgataactgattccctcaggggagaagaaactgggtggctgaaggacaggaatgagaaagaaggacaaatgtttgaagaaccattggctcccttatcaaaatgtaaataccaaggaaaatcaggaatttaagaagtctaagaattctgtaatgctgggtagaattttctgtacgtgtaaaactaaaatgtcttttgtaaatcactgagtcttcctgtttatttctggttagagatctttgggggcttggatggaggaacaggaaaagaggagccaggcttttttggaaaattggcggcagcggtggcatacgggaaactgaaatctttatctaatctcatcctttgtatattcgtcttggatttgctgaagaaaattaaaaggccaggcctaccactcctatggcacagtattgatgagagacatcagtggagctccccacctccaccccaggcttggaacttagggaatgactggtttttgtcatttcacacaacagctgaaggattctgtccccacctcgtcctctgtgaagtctgctggacgtacctgccagaatcttctgaagatgacgtttgctgaacactgacccacaggggtttgatggattattgacaatgagacaagctgtcttttcatcaattagatattccagttgtttcaggtcaatttcccaagatttctctggctggagagaaagaaaggatgagactaagatgattctgaaacatttagggggaatcctcacttatctcaagggtccaatgtaagcaataaagtctgtctctggcttcaaccaccaaaaaaaga

SEQ ID NO: 289094 - DNA, 1030 bp, Homo sapiens
aggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccctagccttcccaggtggccatgtagtcccgtctctctgtggaaagcctgacttctggcttcaccccaaggaataccaacagcagatccatgcaaggttggggtgcctttttgatgagtcttacaggaagggaaggcagtgtgtagagaatcggcttgctctggggatgcctccccattttgcctgctgtccattgaagtctgtgtgttggcatgagatgaatcaggagaaaaataaactggatggtgttttcctttttcttgg

SEQ ID NO: 289095 - DNA, 1171 bp, Homo sapiens
aggagaccccactggctttggtcccctaagaatggactctgctgcctgtgctgctgctgccacccctgttccagccctggctttggccctagctccagacctagcacaagccccactggcactccctggcctgttaagcccatcttgccttctctcctctggacaagaagtaaatgggagtgaaagaggaacttgtctctggaggccctggctgtcttccacaaatgactccccaaggcagatgaggaagctggtggatttggctgctggtggggcaacggctgctgaggtcaccaaggctgaatccaagttccatcaccctgtcaggctcttctggcctaaatcccgctccttcgactatctgtacagtgctggggagattttactgcagaactttcctgtccaggcaaccatcaacctatacgaggactcagacagcgaagaagaagaggaagatgaagagcaggaggatgaagaagagaagtaggaggccaatgaaaaggggccagaagggtgtgtgagggtaccagggtccataccctacagcgccacagctcatcccccttcctcacccctaacctatccaaatggaggcagccagagtctgattggggttcagtttgtctggcaagttttcacagacatcagttagccggaagtattagtccagcagatagagctttctggactgaaaattgggtcatctagctgcccagctcaccctggcttacctgaatggcctgtgagctcaggcctcttgcatctcattgtctgggctgctgttgtgttgaccatgggagggttctaggagctctagaaggaaggcttgctgaagcccccaggaagcagagcagggcagggaatgcccttgtggagggaagtagtcattcctcaggccctttgactccctagccttcccaggtggccatgtagtcccgtctctctgtggaaagcctgacttctggcttcaccccaaggaataccaacagcagatccatgcaaggttggggtgcctttttgatgagtcttacaggaagggaaggcagtgtgtagagaatcggcttgctctggggatgcctccccattttgcctgctgtccattgaagtctgtgtgttggcatgagatgaatcaggagaaaaataaactggatggtgttttcctttttcttgg

SEQ ID NO: 289096 - DNA, 402 bp, Homo sapiens
ctcctcgctttcctccacccgagctccgccggctgctccttgggaggaaggggactcgctagaccaggccgaggcccagcctcagaagtcagcattttcaagacctggcatccgcagcgtttctgacgcggggacttctctcttcggctctgaggtctccgcgcgcagaacccatggcagcttttggtcttacgcgtggctgtgagctgggctcacgctgcgtggcgcatccacccctcgattgacgcgcggagaagcatttttcattttttctttcagcttccctgatttcaaacaaacatcagatttaagaaggtgaggactccaaagaagatccaaacgcgagaccaggaagattcacgtttccactacttcttccaatacatttcactaatctttcta

SEQ ID NO: 289097 - DNA, 772 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggggcggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtatctttagttttattaccaccgtgtacaggtataaataacctcctgacaacactaatccatgttttagcctttaatggttgacacccagattccagcacgctcaataaacttaattctgttgttaaatgata

SEQ ID NO: 289098 - DNA, 4100 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289099 - DNA, 4251 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctaaaaaaaaaaaaaaaaaaaaaattgttgggcggcctgaagtttagaccttgttgggggggccaggtaggatgcgggccagggaccgcgaaggtggtcccaaaaaggggggcggggttgcaaccgaggttgggtgggttaaaggcagactagt

SEQ ID NO: 289100 - DNA, 3773 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289101 - DNA, 4367 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtactccacagagcagcgcaccgctattcccttacgataacatcgtgccctgtatgcttaacgtcgaaggccttcgttccccgtgataaattgtgcagcttgcaccctcttcacatctatctacgcactaagcaggcacgtacaccccaagattagggcgtcgcccaaccagtggccgctgtgcccgagacatcatgaacacagctcttaccatgaagtctcgcgcccattcacactgcatctaacaacaaggtgggtccgatgataataggcgacactcagtctctccgatagctccaccttcgatctactgcgcccatactagagaagtttgccctctattgtctctcacaccacaatgagtcatagaatatgacatgaacccgatgcgatatcgccatttcgtaa

SEQ ID NO: 289102 - DNA, 3566 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaatcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289103 - DNA, 2606 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289104 - DNA, 3251 bp, Homo sapiens
tttttgaaagttttgaacatgctggtgcggtaagtctcctccatctcagcctcccaaagtgctgggattacaggcgtgagccaccgtacccggcccaacaatatactcttaatagtaaaaaacaaaatcaatgagggaattagcattgccatgttagattactgaattttttccccccagttatttaaatgtgtggcagtttttcactccaataaccacatatataaggtatcttcaagaaatttgaagagagccttggaagcatgtggatacctaaataataatttagaaatggcagctgtaaaatctatgatagatttaaaggcattttgttctctaaaacttactatttatgttttaattattgcatgtttacactaaattttaacttgtggttgtttgtttgtctgtttcttattaggtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289105 - DNA, 2781 bp, Homo sapiens
ttcagctcggtaccagtgctactccacaaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289106 - DNA, 2733 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcatgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289107 - DNA, 3623 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttattcatgaggtaagtttcagctttaaaaaaaaaatcttccacaaagatttaccattttcaagaagtacacaataatcataatgccggccgggttgcagatggatcacaccgtttaatcccagaacaaagggaaacaccgggaattcctctaaagttcgacctgtgcag

SEQ ID NO: 289108 - DNA, 3604 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagagaaagaagaaagaacacaagaaagtgaagtccactagggatattgttcctttttctgaacttggaactactccctctggtggtggattttttcagggtatttcttttcctgaaatctccacccgtcctcctttgggcagtaccgaactacaggcagctaagaaagtacatacttctaagggagacctacctagggagcctcttgttgccacaaacttgcctggcaggggacagttgcagaagttagcctctgaaaggaatttgtttatttcatgcaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaaaaaaaatg

SEQ ID NO: 289109 - DNA, 983 bp, Homo sapiens
gcgaagcaggctgctcgcctcctgcctgtagtgtgtgggctggggttggtgcgagcttccagcttggccgcagttggttcgtagttcggctctgggtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289110 - DNA, 1803 bp, Homo sapiens
taggctagtacgaggctgggtgtgaatcggcgatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaaaaaaaatg

SEQ ID NO: 289111 - DNA, 2747 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacaaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgta

SEQ ID NO: 289112 - DNA, 1286 bp, Homo sapiens
tttttcccccgctcaatatgttttatcaaaatttaccccgtagcgtaaatcatttattccccaccacatataatgagatagtgtgtttacaccaagattgccctcgtgatattttacatatatacgcctcgaaatcattacaatcttccactaggtgtaaaagtactcccccgactatttttctcctcacccccccgccaccaataaggtgcggttttcttctccccaacaaataaccacactctcgcgcctcgtgatttccatcctctcccactatttatcaagcaccccaccactactataaatacaactccccccctcaattgggcaccccatttctatataaaaaatggatgttgctgctcaaataaatccgttcgctccccgcagaatagcttttatcggcgccgccccccctcctttatttttttttttttttttttttttttttttttttttttttttttttttatctttttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaaaaaaaatg

SEQ ID NO: 289113 - DNA, 1285 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggtaaaattttaaatgatgttaatcaaatgtatgtaattttttcacactcaaaattcagtgaccatgaagaaagtaaaatttaaaacaatattggcaagatacacaaattttattcgtgtcattagagtaattctgtaatttgatttaaatactttttattgaaaattctaagaagcaacatagtacaaattcataattttccatcacctgaaattgcaagttaactttgtcttttttgctacaaatctaatttttctgagagaataaagtattacaagtaaaggcaaagtttctcgtacttacctgtacctatcacctccacagaagtaactactattattaattcaatgcctgtctttcaagttttatatttcacatacacatctgtctaatacatggtattattttatactttaagaataaaaaatttatataaacag

SEQ ID NO: 289114 - DNA, 966 bp, Homo sapiens
  misc_feature (688)..(688): n is a, c, g, or t
  misc_feature (691)..(692): n is a, c, g, or t
  misc_feature (699)..(700): n is a, c, g, or t
  misc_feature (703)..(703): n is a, c, g, or t
  misc_feature (705)..(705): n is a, c, g, or t
  misc_feature (708)..(708): n is a, c, g, or t
  misc_feature (710)..(710): n is a, c, g, or t
  misc_feature (713)..(713): n is a, c, g, or t
  misc_feature (722)..(722): n is a, c, g, or t
  misc_feature (726)..(726): n is a, c, g, or t
  misc_feature (728)..(728): n is a, c, g, or t
  misc_feature (771)..(771): n is a, c, g, or t
  misc_feature (804)..(804): n is a, c, g, or t
  misc_feature (941)..(941): n is a, c, g, or t
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggnacnnccaggannctntntgngnccncgcttttgnccangngggcaccccggccccgcctccacagctcttttcctagtgtggnccacctttgttgttgcagcacccctccccgggngcctggccagtcctgcttttgcaccgctcccagatagcccctgccagccgacactatcccctcgcagttacacaggttgcagccgcagcgccctcatcccgggacagcgccccgcatggcgtccccctcccaccccnccgcgttgcaacccctacgcgctct

SEQ ID NO: 289115 - DNA, 1519 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatca

SEQ ID NO: 289116 - DNA, 3660 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaaggaaagaagaaagaacacaagaaagtgaagtccactagggatattgttcctttttctgaacttggaactactccctctggtggtggattttttcagggtatttcttttcctgaaatctccacccgtcctcctttgggcagtaccgaactacaggcagctaagaaagtacatacttctaagggagacctacctagggagcctcttgttgccacaaacttgcctggcaggggacagttgcagaagttagcctctgaaaggaatttgtttatttcatgcaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaaaaaaaatg

SEQ ID NO: 289117 - DNA, 4173 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctctagttttgtcgttgcaataaatggttttcagatagcacaaactgtcgatttctggataacatttcttatgtaata

SEQ ID NO: 289118 - DNA, 4019 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgta

SEQ ID NO: 289119 - DNA, 3521 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289120 - DNA, 3186 bp, Homo sapiens
gactttttaatgtgttgatgcttgaatagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatcactttgtgccatatgaataatcttttttagctctggaactttttgtaggctttatttttttaatgtgggcatcttatttcatttttgaaaaaatgtatatgttttttgtgtatttgggaaacgaagggtgaaacatggtagtataatgtgaagctacacatttaaatacttagaattcttacagaaaagattttaagaattattctctgctgaataaaaactgcaaatatgtgaaacataatgaaattcagtaagaggaaaagtaacttggttgtactttttgtaactgcaacaaagtttgatggtgtttatgaggaaaagtacagcaataatctcttctgtaacctttattaatagtaatgttgttgtagccctatcatactcactttttaagacacagtatcatgaaagtcctatttcagtaagacccatttacatacagtagatttttagcagagatcttttagtgtaacatacatattttagagaattgttggctagctgtacatgttttgaaaagctgtttagctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagtacaaaaagggccgggcgcggtggcttacgcctgtaatcccagcactttgggaggccagggcgggtggatcacgaggtcaggagatcgagaccatcctggccaacatggtgaaaccccgtctctactaaaaatacaaaaaaattacgctgggcgtgatgatgtgcgcctgtagtcctgtctactagggagactgaggcaggagaatcgtttgaacccaggaggcagaggttgcagtgagcagagattacgtcactgcactgtagcctggcgacagagcgagactccatctcaaaaaaaataaaaaagtacaaaaagtacttgcttttatattacatcataagcagtagttaataaagttgtatactcttaagaggtgggcattatgattattttttatttttttattttttatgagatggagtctcgctcttgtcacccagactgtagtgcagtggcacgatctgggctcggtgcaacctctgcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289121 - DNA, 2205 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattcctcccgggttcaagcaattttcctgcctcggcagagacggggtttcaccatgttggccaggctggtctcgaacccctgacctcaagtgatcagcccacctcagcttcccaaagtgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289122 - DNA, 2419 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgggattacaggtgtgatccactgcacccggccggcattatgattttgtgtactcttgaaatggttatctttgtggatgatttttttttttaagctgaaacttacctcatgaataacttgattaaagtagtaggtgattaaaatttcaatagaatcaaatgagacaaaaattttaaactgactcatttgagtttcaactttacagtcattgaccataaagcacactaaaaatgtaagttatttttaaatacatctgaaataaaaatacttactaaaaaggaagaagccgaagatgtatatttagaccagcacacaattttgatttcaattagccttattctaatatttagcttttagatctttcatacacattttcacgtactttgcaattgagaccagaaagacttgtaggtctttctgcagaatgagtgggtccttgcaaagtgagtgggaaacttactcctagatcagaaatgtttgcctctctgagtaaaatgtttctttcagatgagccatagagggggcaccttttactcaacttttctttgttttgaaactttgtttcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaaatgcaaagcatttcttcctgattaaattgtagatgtagactttacaatataattcaataataaaaagtaattaacctcta

SEQ ID NO: 289123 - DNA, 2618 bp, Homo sapiens
gttcggcacgagaaaacatacagaagagaattgatcagtctaagtttcaagaaactgaattcctgtctcctccaagaaaagtctagccatgataggtgtttagagaaaagttcttcgtcatcttctcagcctgaacacagtgccatgttggtctctactgcagcttctccttcactgattaaagaaaccaccactggttactataaagacatagtagaaaatatttgcggtagagagaaaagtggaattcaaccattatgtcctgagaggtcccatatttcagatcaatcgcctctctccagtaaaaggaaagcactagaagagtctgagagctcacaactaatttctccgccacttgcccaggcaatcagagattatgtcaattctctgttggtccagggtggggtaggtagtttgcctggaacttctaactctatgcccccactggatgtagaaaacatacagaagagaattgatcagtctaagtttcaagaaactgaattcctgtctcctccaagaaaagtccctagactgagtgagaagtcagtggaggaaagggattcaggttcctttgtggcatttcagaacatacctggatccgaactgatgtcttcttttgccaaaactgttgtctctcattcactcactaccttaggtctagaagtggctaagcaatcacagcatgataaaatagatgcctcagaactatcttttcccttccatgaatctattttaaaagtaattgaagaagaatggcagcaagttgacaggcagctgccttcactggcatgcaaatatccagtttcttccagggaggcaacacagatattatcagttccaaaagtagatgatgaaatcctagggtttatttctgaagccactccactaggaggtattcaagcagcctccactgagtcttgcaatcagcagttggacttagcactctgtagagcatatgaagctgcagcatcagcattgcagattgcaactcacactgcctttgtagctaaggctatgcaggcagacattagtcaagctgcacagattcttagctcagatcctagtcgtacccaccaagcgcttgggattctgagcaaaacatatgatgcagcctcatatatttgtgaagctgcatttgatgaagtgaagatggctgcccataccatgggaaatgccactgtaggtcgtcgatacctctggctgaaggattgcaaaattaatttagcttctaagaataagctggcttccactccctttaaaggtggaacattatttggaggagaagtatgcaaagtaattaaaaagcgtggaaataaacactagtaaaattaaggacaaaaagacatctatcttatctttcaggtactttatgccaacattttcttttctgttaaggttgttttagtttccagatagggctaattacaaaatgttaagcttctacccatcaaattacagtataaaagtaattgcctgtgtagaactacttgtcttttctaaagatttgcgtagataggaagcctggtacaaacaatttaacgctttctagatcacatattagtctctaagttgttttctgtttcctgctttacttatgtttttacaattctccaaaactaagaaaattctaattaggatataaggagtatttactgttcaatagaataatatgcatcctcctttatacctaggacagaattaaacatttgttacacattcagaacagtgatgttgttctttttgatacttttatctcagtatcttttcacgttccataacttgtccatatttttgctcatattttcttacttttctttgttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaaaaaaaatg

SEQ ID NO: 289124 - DNA, 1846 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcagagctattctcaagctggaataactgagactgaatggacaagtggatcttcaaaaggcggacctctgcaggcattaactagggaatctacaagagggtcaagaagaactccaaggaaaagggtggaaacttcagaacattttcgtatagatggtccagtaatttcagagagtactcccatagctgaaactataatggcttcaagcaacgaatccttagttgtcaatagggtgactggaaatttcaagcatgcatctcctattctgccaatcactgaattctcagacatacccagaagagcaccaaagaaaccattgacaagagctgaagtgggagaaaaaacagaggaaagaagagtagaaagggatattcttaaggaaatgttcccctatgaagcatctacaccaacaggaattagtgctagttgccgcagaccaatcaaaggggctgcaggccggccattagaactcagtgatttcaggatggaggagtctttttcatctaaatatgttcctaagtatgttcccttggcagatgtcaagtcagaaaagacaaaaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataaatgtagtatttcattgaaaagcaaacaaaatatatataaatggacttcattaaaatgtttttgaactttggactagtaggagatca

SEQ ID NO: 289125 - DNA, 1077 bp, Homo sapiens
gcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcaggaaagccacaaaaaaaactgataaacccagacaagaagataaagatgatctagatgtaacagagctcactaatgaagatcttttggatcagcttgtgaaatacggagtgaatcctggtcctattgtgggaacaaccaggaagctatatgagaaaaagcttttgaaactgagggaacaaggaacagaatcaagatcttctactcctctgccaacaatttcttcttcagcagaaaatacaaggcagaatggaagtaatgattctgacagatacagtgacaatgaagaagactctaaaatagagctcaagcttgagaagagagaaccactaaagggcagagcaaagactccagtaacactcaagcaaagaagagttgagcacaatcaggtatctttagttttattaccaccgtgtacaggtataaataacctcctgacaacactaatccatgttttagcctttaatggttgacacccagattccagcacgctcaataaacttaattctgttgttaaatgata

SEQ ID NO: 289126 - DNA, 2382 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289127 - DNA, 757 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccagcctgagcaaggtatcaggtgtttcgattgcagaaggtggaggctgccagctcttgcaggttgaaaatgaggagctaagtagattttttttgtttgtttcaaaagaccattacttgaaccttgggagcagtggtcctcaaggtgtggtcttgggaccggcagcatcagtaacacctgggaatttattagaaagaa

SEQ ID NO: 289128 - DNA, 2705 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289129 - DNA, 2274 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcaatggcttcaagacaaccagaagtgcctgaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289130 - DNA, 2080 bp, Homo sapiens
gcactccaactctgtaactttagtgtgtggagtgcttcggccactcgaaggtacttggtctcctcggtggtgaggcccttcacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289131 - DNA, 3282 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaaaaaacaagaaggaaaaagaagaaaacaagaagaaagaaacagaaaaaagaaaacacacaggcagcaaagcaagaacacaagacgcacaaggagagaaagagaagagaagagagagaggagacaagcagggagagaggagagagcggcgagagagaggggggaggacagaacggggcgatctaacagagagcaggaggtggtgggcaaggacagaaccccgcgctccatggagagcgagcttttgtgcggaccgagaagagagacgtactagagaatgagtgacgagggatgtgacacaccatagagaagcgtgaggagagatagaagtataatgttgtcaacatcagtaagagccggggcgtcggcctgtaacgtgcacatgaggatagtggctctgactacgagagttcgtaagagcttgtgttgtctatacatacggaagttggagtatataatcgacatagaaggt

SEQ ID NO: 289132 - DNA, 1301 bp, Homo sapiens
  misc_feature (1)..(1): n is a, c, g, or t
  misc_feature (24)..(24): n is a, c, g, or t
nagaattacatcggggcaaccccntcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289133 - DNA, 3105 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaaaaaaaaaaaaaaaaaaaaaaaaaaggggggggggtaaaaagtttcccgggggggccaaagttaaggggtacccggtttccgggcacaaggggggccccaatgaggggaggcgttattaaaaggaaggcgacacggggccgccgtttcacaaccgccgtgacgggggcaacaccggtatctggagactggggaaaggaccctacctcccggggggcgacatcatgggcgcactcctcagaagttaaaggtccaggaaacatcaacctcaaggcgtacgcgtacctagcgcttg

SEQ ID NO: 289134 - DNA, 2759 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289135 - DNA, 677 bp, Homo sapiens
ggtggacaaaatggcgaagatcgccaagactcacgaagatattgaagcacagattcgagaaattcaaggcaagaaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289136 - DNA, 2857 bp, Homo sapiens
  misc_feature (2144)..(2144): n is a, c, g, or t
  misc_feature (2152)..(2152): n is a, c, g, or t
  misc_feature (2161)..(2161): n is a, c, g, or t
  misc_feature (2169)..(2169): n is a, c, g, or t
  misc_feature (2171)..(2171): n is a, c, g, or t
  misc_feature (2183)..(2184): n is a, c, g, or t
  misc_feature (2208)..(2209): n is a, c, g, or t
  misc_feature (2211)..(2211): n is a, c, g, or t
  misc_feature (2217)..(2217): n is a, c, g, or t
  misc_feature (2238)..(2238): n is a, c, g, or t
  misc_feature (2242)..(2242): n is a, c, g, or t
  misc_feature (2249)..(2251): n is a, c, g, or t
  misc_feature (2276)..(2276): n is a, c, g, or t
  misc_feature (2278)..(2279): n is a, c, g, or t
  misc_feature (2287)..(2288): n is a, c, g, or t
  misc_feature (2290)..(2290): n is a, c, g, or t
  misc_feature (2293)..(2293): n is a, c, g, or t
  misc_feature (2316)..(2316): n is a, c, g, or t
  misc_feature (2327)..(2327): n is a, c, g, or t
  misc_feature (2340)..(2340): n is a, c, g, or t
  misc_feature (2344)..(2344): n is a, c, g, or t
  misc_feature (2361)..(2361): n is a, c, g, or t
  misc_feature (2364)..(2364): n is a, c, g, or t
  misc_feature (2366)..(2366): n is a, c, g, or t
  misc_feature (2371)..(2371): n is a, c, g, or t
  misc_feature (2378)..(2378): n is a, c, g, or t
  misc_feature (2386)..(2386): n is a, c, g, or t
  misc_feature (2391)..(2391): n is a, c, g, or t
  misc_feature (2398)..(2398): n is a, c, g, or t
  misc_feature (2400)..(2400): n is a, c, g, or t
  misc_feature (2404)..(2404): n is a, c, g, or t
  misc_feature (2424)..(2424): n is a, c, g, or t
  misc_feature (2436)..(2436): n is a, c, g, or t
  misc_feature (2444)..(2444): n is a, c, g, or t
  misc_feature (2447)..(2449): n is a, c, g, or t
  misc_feature (2456)..(2456): n is a, c, g, or t
  misc_feature (2484)..(2485): n is a, c, g, or t
  misc_feature (2497)..(2497): n is a, c, g, or t
  misc_feature (2500)..(2500): n is a, c, g, or t
  misc_feature (2503)..(2503): n is a, c, g, or t
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggngggggcgnggggggggngcgggcgngngtggggcggggnngggggggcggggggggggggggcnngntggggngcgggggggggggggggcggngggngcgggtnnnggggcgggggggggggggcggcggngnnggcggggnngntgnggcgctgggaggggggggtggtntggggggggtngggttgagggctncgcnggggggggggggggggnggngngggtngggggangggtaggnggggngtggggngntggntgggggtgggggggggtggnggggggcgcggntggggtgnggnnntgggggngcgggggggggcgcggggggggggggcnnggctgtgggttnccntgnggcgggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289137 - DNA, 3069 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggtttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaaaaatgtggctatttttttgtccttttaacaatagttattccactctgcccacccagagtcacactgaacttggtattttgaaaaaccattgcctttttattgtctccttttaacatcaaatgttttataacacacttgatccttttgtttctaccccctattcattacagtcaaattaacaggcaatataataggtctaacagaatgcttgcatttcattagggaaaaatgaacgtctctctcctgaaacaggttgtcggtaccttgaatgacataatattggtgtatagactaggttcagcagagggattttttccacatcttgaatgaaaatgttaaacatgtgatgcacagagtattaacctgtttcaaaaaagtatagataaataatttattaaaaaatatatataccttgtatatttaagccatatttgagaacaggctaggataggattatttaaaaaaagatatttactagagttagaaattacaacctactgattaaataatgcaggtttggtcctgtaagattttaaccacttttcatgcttttagagcttctgagcagttggagagagagttcaggaggtattcttggcattcagtgcttggcaggccctcaggagccgctccagcccttttgaaagggctctgcatcagggttcaagtccgcagcatagaagagcaggagcttcaacaagtgcactttgtcttggagttgggggacaagaggctcccccagcatctggatcaggcggctgcggaaggcctcaatctgcttctctacgtctaccactgtgatgtcatctccttgctggggtttgggcttaatccttttgattattaagtcctttcggtcgatcacggaactccttaagtgttctcttaaaacatgttgataactggacagcagaaactgcagatgctcaaccaattcgtcccaagtctgccactggcttttatctgactgacacttgagcagtgacgtagaattattcagaaagtagagggcctgggccagagacagaggcaggcgggtgggtgtctcacagctgtggaggaatatgatttctaacactttgcagcgcagaaggtggctttccatggtagtaaagaacatttctctctggctcctctcaggaatgtccagcacaaacccaaacatcatctcggcaattttattggagctgcaggtgggggtcctgtccacctctacggctatggagagcatcctctgaagctggcacacaatcagctgattggtgttctttgtcaggttgggctgggaagaagggtggctactgctggctttcaagattcctgttcctgaagacgtttgatttccatttgggggctgagtcaat

SEQ ID NO: 289138 - DNA, 1328 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacgtaagctcttaggaactttgaaaaaacaaaaccttcagtgttcatggcttgaaatgtggctgtggttttgaagttaccagctcagttagttgggggctgtggagttagtctcgctcccgagctcttagccctcgtagtttttgcttatccacctatacagtggggtgtctgttttgctacttctggttagcagaatcaagtgagagcctcagcttacatatacataggagtactttatgaatcataaagcaaatgtggagtatcttggggagaactgggcagcctcaacagaggtaacagcttaactggaaaggaacaagttaaaatcaaatgtggaattggaatgtttttgctatttcatttctataagtgaagaattttggtaagggttaatttagtgatagccaagtatttgaatgaatagtttcaaatgactttctttcagtgaagaccgcttcatactggatagtgttttatgattgtgaagcacttgcattcatttcatcctcaca

SEQ ID NO: 289139 - DNA, 1749 bp, Homo sapiens
gctgtttgctccacaaaatgcctcttaatcgtgtatttatttctctctctgagtcgcttatctactttaataggtgttatgtttcgtgatctgttgtctattcagcaactatgtgagttttgtttcgttttcatttagataccagtcgtcctgtctttttgattgtgcctacttagtcggatctttatattatatactaccacgaggcgctggtcgtgtttgttttataacttatctggatttcgtagagtcgtctcgctttagtttccaaaatatacttatcgtctggttggtgctgtgtcgcgcccgtgggcgttctattagtggggtgtgcccccgtcctcttttttgttcgtttgttgtggtgttttcttttcttcttttttttttttttttttttttttttttttttttttttttttttttttttttttttttttttttttttttttttttggtattttgaaaaaccattgcctttttattgtctccttttaacatcaaatgttttataacacacttgatccttttgtttctaccccctattcattacagtcaaattaacaggcaatataataggtctaacagaatgcttgcatttcattagggaaaaatgaacgtctctctcctgaaacaggttgtcggtaccttgaatgacataatattggtgtatagactaggttcagcagagggattttttccacatcttgaatgaaaatgttaaacatgtgatgcacagagtattaacctgtttcaaaaaagtatagataaataatttattaaaaaatatatataccttgtatatttaagccatatttgagaacaggctaggataggattatttaaaaaaagatatttactagagttagaaattacaacctactgattaaataatgcaggtttggtcctgtaagattttaaccacttttcatgcttttagagcttctgagcagttggagagagagttcaggaggtattcttggcattcagtgcttggcaggccctcaggagccgctccagcccttttgaaagggctctgcatcagggttcaagtccgcagcatagaagagcaggagcttcaacaagtgcactttgtcttggagttgggggacaagaggctcccccagcatctggatcaggcggctgcggaaggcctcaatctgcttctctacgtctaccactgtgatgtcatctccttgctggggtttgggcttaatccttttgattattaagtcctttcggtcgatcacggaactccttaagtgttctcttaaaacatgttgataactggacagcagaaactgcagatgctcaaccaattcgtcccaagtctgccactggcttttatctgactgacacttgagcagtgacgtagaattattcagaaagtagagggcctgggccagagacagaggcaggcgggtgggtgtctcacagctgtggaggaatatgatttctaacactttgcagcgcagaaggtggctttccatggtagtaaagaacatttctctctggctcctctcaggaatgtccagcacaaacccaaacatcatctcggcaattttattggagctgcaggtgggggtcctgtccacctctacggctatggagagcatcctctgaagctggcacacaatcagctgattggtgttctttgtcaggttgggctgggaagaagggtggctactgctggctttcaagattcctgttcctgaagacgtttgatttccatttgggggctgagtcaat

SEQ ID NO: 289140 - DNA, 534 bp, Homo sapiens
tggataatacctatctagctgggtggagatgaccaactcctcccttcaatgatttcctcacttaccagattaatgttatttcagtaacttcctccccaaaggagtaagtttaggtgtgtgactcccctgccctgcctaagtgcttctgtactgtacctctcttgaacaggtggaggaaggagaggccagtctaccctcccctgccatgaccctgtcatcagccattgacagtgtggacaaggtcccagtggtgaaggctaaagctacccatgtcatcatgaattctctgatcacaaaacactcttcaccctcagagtagagtgccataggggcagggaagagttgaggcttcctacaagctgattggagatgatactgcaacacgctcgccttaccttatcctaaaaaatgtcagtttggctgctgaatcatgtcagtattgaagctccatttattaagtggaagatttgccaaatgttaagcatcttatctgatttaggtgcattcctgctgctttgttgatatgatctcatg

SEQ ID NO: 289141 - DNA, 2813 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289142 - DNA, 2295 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtgaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289143 - DNA, 2027 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaac

SEQ ID NO: 289144 - DNA, 2618 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289145 - DNA, 2726 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289146 - DNA, 2441 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289147 - DNA, 2187 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289148 - DNA, 2026 bp, Homo sapiens
agtgtggcagatgaggttgtatttaagcctgtggtttcagagggagaagggatagttccctgttcttttggtgtgagacatttctaggggcgaaggaagaggtattttaggatatgttttgttctttctttcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289149 - DNA, 4177 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaaaaatgtggctatttttttgtccttttaacaatagttattccactctgcccacccagagtcacactgaacttggtattttgaaaaaccattgcctttttattgtctccttttaacatcaaatgttttataacacacttgatccttttgtttctaccccctattcattacagtcaaattaacaggcaatataataggtctaacagaatgcttgcatttcattagggaaaaatgaacgtctctctcctgaaacaggttgtcggtaccttgaatgacataatattggtgtatagactaggttcagcagagggattttttccacatcttgaatgaaaatgttaaacatgtgatgcacagagtattaacctgtttcaaaaaagtatagataaataatttattaaaaaatatatataccttgtatatttaagccatatttgagaacaggctaggataggattatttaaaaaaagatatttactagagttagaaattacaacctactgattaaataatgcaggtttggtcctgtaagattttaaccacttttcatgcttttagagcttctgagcagttggagagagagttcaggaggtattcttggcattcagtgcttggcaggccctcaggagccgctccagcccttttgaaagggctctgcatcagggttcaagtccgcagcatagaagagcaggagcttcaacaagtgcactttgtcttggagttgggggacaagaggctcccccagcatctggatcaggcggctgcggaaggcctcaatctgcttctctacgtctaccactgtgatgtcatctccttgctggggtttgggcttaatccttttgattattaagtcctttcggtcgatcacggaactccttaagtgttctcttaaaacatgttgataactggacagcagaaactgcagatgctcaaccaattcgtcccaagtctgccactggcttttatctgactgacacttgagcagtgacgtagaattattcagaaagtagagggcctgggccagagacagaggcaggcgggtgggtgtctcacagctgtggaggaatatgatttctaacactttgcagcgcagaaggtggctttccatggtagtaaagaacatttctctctggctcctctcaggaatgtccagcacaaacccaaacatcatctcggcaattttattggagctgcaggtgggggtcctgtccacctctacggctatggagagcatcctctgaagctggcacacaatcagctgattggtgttctttgtcaggttgggctgggaagaagggtggctactgctggctttcaagattcctgttcctgaagacgtttgatttccatttgggggctgagtcaat

SEQ ID NO: 289150 - DNA, 2832 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggcgtggtggctcacgcctgtaatcccagcactttgggaggccaaggtaggtggatacctgaggtcaggagttcaagaccagcctggccaacatggtgaaaccccgtctctactaaaaatacaaaaattagctgggcgtggtggtgggcgcctgtagtcccagctacttgggaggctgaggcaggagaatcgcctgaacccaggaagcagatgttgtaccgagctgagatcatgccattacactccagcctgggcgacagaacgagacgccatcaataaataaataaataaagtaaagtaaaaaacctattaaattgaggctagagctggagatgtaattggtttttgagaaacattagtataaagcttgcccttgttgtgtggaagaagccattttgtactgctttaaagttagactaatattctcagcacgggtgtatggggacctcattacctatttttttcatcatttaccctaggtaagaactttgatcactgcttactaggtaaagaatgtttgtactgttccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtaaggtgttcaataaagaacatgaaccaaaaaaaaaaaaaaaaaaaaaaaaaaaaaaaaaaaaaaaaagaaaaagaaaattatacaaaaaaatatgaatagaatagactatattcagaaaccaaaaagctagactatattcaaataggaggaaaaaaaaaaaccttggggggggccccggtcccaaattgcccttaagggggggcgtttaaaaattaatgggccccgttttaaaaacagcgattttggaaaacccttggggtcccaatttaaaacccttggaagaaaacccccttttttcaggtggggtaaaaggcaaaaggccccccacggtgggctttttaaaaatttggccaccttaatgggcaattggaaattgtaccgtgtaattttgttaaaaaatggggtaa

SEQ ID NO: 289151 - DNA, 770 bp, Homo sapiens
  misc_feature (31)..(31): n is a, c, g, or t
  misc_feature (42)..(42): n is a, c, g, or t
  misc_feature (44)..(44): n is a, c, g, or t
  misc_feature (50)..(50): n is a, c, g, or t
  misc_feature (54)..(54): n is a, c, g, or t
  misc_feature (57)..(57): n is a, c, g, or t
  misc_feature (59)..(60): n is a, c, g, or t
  misc_feature (79)..(79): n is a, c, g, or t
  misc_feature (90)..(90): n is a, c, g, or t
  misc_feature (94)..(94): n is a, c, g, or t
  misc_feature (110)..(110): n is a, c, g, or t
  misc_feature (114)..(114): n is a, c, g, or t
  misc_feature (129)..(130): n is a, c, g, or t
  misc_feature (134)..(134): n is a, c, g, or t
  misc_feature (136)..(137): n is a, c, g, or t
  misc_feature (143)..(143): n is a, c, g, or t
  misc_feature (156)..(156): n is a, c, g, or t
  misc_feature (162)..(162): n is a, c, g, or t
  misc_feature (169)..(169): n is a, c, g, or t
  misc_feature (196)..(198): n is a, c, g, or t
  misc_feature (207)..(207): n is a, c, g, or t
  misc_feature (213)..(213): n is a, c, g, or t
  misc_feature (227)..(227): n is a, c, g, or t
  misc_feature (232)..(233): n is a, c, g, or t
  misc_feature (237)..(237): n is a, c, g, or t
  misc_feature (240)..(240): n is a, c, g, or t
  misc_feature (242)..(243): n is a, c, g, or t
agtaacggctgctggcctcccaaagtgctgngagtgtaggcntnagccanctcnccngnntgctcagtgcttacctctntaacctcattnctanccatggtctcccttgntcancgtactccagccacnntgtncnntccgcnggtccttgaacanatcganttcattncttccttaagacattttctccagatgnnntctctgctntggctnctttcctttctttncattnngatngcntnnagacagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacggaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaa

SEQ ID NO: 289152 - DNA, 1840 bp, Homo sapiens
agcggcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacagaacctctggatggactcttcctgggaagctttgctactttgcagcagctggaccatgttcctcattaacatctgtctgtccgcttagtcatcacatcatttcactgtggtggcagggactcagctcggaattctgtatagaaaaagcacctggatcccagtctttcaatggcttcaagacaaccagaagtgcctgctcttgaggctagtgcgcctctaggcaagatgtccctgcccatcgggatataccgccgggcagtcagctatgatgataccctcgaggaccctgcgcccatgactcctcctccatcggacatgggcagcgtcccttggaagccagtgattccagagcgcaagtatcagcacctcgccaaggtggaggaaggagaggccagtctaccctcccctgccatgaccctgtcatcagccattgacagtgtggacaaggtcccagtggtgaaggctaaagctacccatgtcatcatgaattctctgatcacaaaacagacccaggaaagcattcagcattttgagcgacaggcagggctgagagatgctggctacacaccccacaagggcctcaccaccgaggagaccaagtaccttcgagtggccgaagcactccacaaactaaagttacagagtggagaggtaacaaaagaagagaggcagcctgcatcagcccagtccaccccaagcaccactccgcactcttcacctaagcagaggcccaggggctggttcacttctggttcttccacagccttacctggcccaaatcctagcaccatggactctggaagtggggataaggacagaaacttgtcagataagtggagcctctttggaccgagatcccttcagaagtacgattctggaagttttgccacccaggcctaccgaggagcccagaagccctctccattggaactgatacgtgcccaggccaaccgaatggctgaagatccagcagccttgaagccccccaagatggacatcccagtgatggaaggaaagaaacagccaccacgggcccataacctcaaaccccgtgacctgaatgtgctcacacccactggcttctagagccctctttccagggattctggtaaaggtggtttcttgcatcccactccccttttaccttggctttgacataggaaaggtatatttaaaaacttaatcagctgggattacaggcatgagccaccgtgctcagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaacctactgtatttaaatagttctggaaaaatgaaagtgctttttgc

SEQ ID NO: 289153 - DNA, 541 bp, Homo sapiens
attagggagataaggataagacaagcttggttatttattgataattattgaagatgggtgatggctagtggggtttttttaagctattctttctccttctgcctatgtttaaaatttttcaaaataagaagttaaaaaaaaccgttatcacaaactcatagtccacactcttccactaccgttaataaacaactagctaaaaatggtttagatgcctctcaaaaatggtgggatgctttcacaaaatttagaatatctggatactatgagacagcatttttaatctcaagcataaagcaatggccacatatggtggctcatgcctacaatcctagcaccttgagaagccaaagtgggaggatcacttgaggccaggagtttgagaccaacagggcaaaacagtaggacctcatctcaacaaaaattttaaaaaattagccaggtgtagtggtgcacacctgtagtcccagctacaaggcaggctgagattacaggtgtgagccatcgtgcctgaccttagatcctttttaaatcaaactgc

SEQ ID NO: 289154 - DNA, 278 bp, Homo sapiens
gaggtaccagagaataactggaatccagacctatggctgaggactcacttatactgagaaaggagtcccctttctgtacatatattctctgaatattgaagatcagatttcttctatcaataattagaactctatgaaagatttttaattctgcaatttatgttttaaatgctcattgtttcctataactttttcaaaaacaacttggttaaaactcttctgtcttaacttaaaatagattacctataacagtggcttcgctttctgtttcttatcag

SEQ ID NO: 289155 - DNA, 337 bp, Homo sapiens
ggtgtggggaatggacattgactttgtggggctggaaagtgatctttcaagaaaggattaaccaaaggaaatgggaaattgaggtcaggatggataaggaaaccatggggcaaattgggtggtaaaaaaaaaacgaggatggcctttaggttccaagagggccccagataaaagcctggattagaagaaagtaaaaagaaagatcagtgagaaatctccccctcccccaatccttgagaaacctcctgatgagcctatatcttcccagtcctccctgagaggccctagacctgtacaccaacactcattcccaaacactatgaacctcagtttgact

SEQ ID NO: 289156 - DNA, 502 bp, Homo sapiens
atcaccacacctggctgatttttgtggttttatttgttttgttttgttttgttttgttttgttttgttttgttttagtagagacaggttttcaccatgttgaccaggctggtctcgaactcctgactttgtgatctgcccacctcggcctccccaagcgctgggattacagacatgagccaccatgcccagccacaaagacatttcaaaatgcctcctgtaagcaaggcctaggcataaaagttacatcacctgagtgttaaacccagcaatatgtcacaatgccccaagtgggcaaatcacaggcagaagagtcacaaattatcagtgcagggcccagcaatatgtcacaatgttccctgaaggcaaacctaaaagaagaatcacataagctaggtgttgggtgtagcaatatgctacagtttccctgtaagcaaggaccaacagaagaagaggtcgacgcggccgcgaatttagtagtagtagtagtagtaggcagccgc

SEQ ID NO: 289157 - DNA, 814 bp, Homo sapiens
ctaggtatgagagtcaccacaccattacatctgtgtgcttggccaagttatatgtcacaattccacctgtgggtagagaacaagcacaagagtcacatcaactgtgtgctgagccagggttatgtcacaatcttccctgacagcatgcaccagcaaggagagtcacatcacagagttctcaaccagagatgttataatcctctcctgaaagcagggcataggaagaagagtatgatcacctgggtgtcacaaggctcactgtaggcaaagcccagaaaagatagacaaaacacctggttcctgggcccagcaatatatcacaatcttctctatgggaagaaggcaggtagaagtagagggtttcatctcccaggtgatggataaaaaaatatattccaaggccctctgtgggaggggctcaggcagaagccttccaacccctaggtgtttgtttcagtgatatgtcacaataaccaaaatatgcaggtctcaggcaagtgagaagagccacatcacctaggtgctaggtccagtgatctgccacaaatttttcttttggcagtgctcaagcggaacagaaaagtcaaatcgccaagataatgaatgaaaagatgtgttagaatagttctgtgtgagagcccacacaggaaagtctcatcataatgttgttggacccagagacatgttgaaatacatgatgccagccaggtgcggtggctcacaccggtaatcccagcactttaggaggctgaggtcggtggatcacctgaggttgggagttcgagaccagcctgaccaacatgaagaaacccca

SEQ ID NO: 289158 - DNA, 578 bp, Homo sapiens
atcaccacacctggctgatttttgtggttttatttgttttgttttgttttgttttgttttgttttgttttgttttagtagagacaggttttcaccatgttgaccaggctggtagaagtagagggtttcatctcccaggtgatggataaaaaaatatattccaaggccctctgtgggaggggctcaggcagaagccttccaacccctaggtgtttgtttcagtgatatgtcacaataaccaaaatatgcaggtctcaggcaagtgagaagagccacatcacctaggtgctaggtccagtgatctgccacaaatttttcttttggcagtgctcaagcggaacagaaaagtcaaatcgccaagataatgaatgaaaagatgtgttagaatagttctgtgtgagagcccacacaggaaagtctcatcataatgttgttggacccagagacatgttgaaatacatgatgccagccaggtgcggtggctcacaccggtaatcccagcactttaggaggctgaggtcggtggatcacctgaggttgggagttcgagaccagcctgaccaacatgaagaaacccca

SEQ ID NO: 289159 - DNA, 3439 bp, Homo sapiens
accgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaa

SEQ ID NO: 289160 - DNA, 2461 bp, Homo sapiens
accgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctc

SEQ ID NO: 289161 - DNA, 3563 bp, Homo sapiens
  misc_feature (3451)..(3451): n is a, c, g, or t
  misc_feature (3453)..(3454): n is a, c, g, or t
  misc_feature (3461)..(3462): n is a, c, g, or t
  misc_feature (3465)..(3465): n is a, c, g, or t
  misc_feature (3468)..(3468): n is a, c, g, or t
  misc_feature (3478)..(3478): n is a, c, g, or t
  misc_feature (3484)..(3485): n is a, c, g, or t
  misc_feature (3563)..(3563): n is a, c, g, or t
accgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaaaaaaaaaaaaanannaaaaaannggnggncccccccccngggggnnttttttttttttttttttttttttttttttttttttttttttttttttttttttttttttataaaacaaaaatacacn

SEQ ID NO: 289162 - DNA, 3318 bp, Homo sapiens
  misc_feature (3308)..(3309): n is a, c, g, or t
accgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtgattctgccgggnnatcctaacg

SEQ ID NO: 289163 - DNA, 1291 bp, Homo sapiens
  misc_feature (1)..(1): n is a, c, g, or t
  misc_feature (62)..(62): n is a, c, g, or t
  misc_feature (71)..(72): n is a, c, g, or t
nctttgaggcaacgggatcaaccctgctgaggatttacaacacgttgagtacctccttattnatggaacannagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaa

SEQ ID NO: 289164 - DNA, 3361 bp, Homo sapiens
accgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaa

SEQ ID NO: 289165 - DNA, 1186 bp, Homo sapiens
ataccatgtatgctcgtgagagctcatttgaatttacgtatttttttttttaagaagagtactgacttcctaattctaacttcttttctttctctctctagtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttactatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaa

SEQ ID NO: 289166 - DNA, 2982 bp, Homo sapiens
accgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttactatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaa

SEQ ID NO: 289167 - DNA, 301 bp, Homo sapiens
atactacattagtaatgaatataaaggaatgccaggaggaaggaatctttataagtaagagctctgtcaagttgttgacttgagtcattttagctgacgaacaatttctgaactctatttttattttttgccttgtcctaactaatattaaactggtattgctattgagcactttttattccttcataaatcaatctacatgtccacaagagagaatggctttattcgatgttttgtgatatttccaaacaatggaaggtttgaggttactattaattcatgtatttatttcatgctaaaa

SEQ ID NO: 289168 - DNA, 3061 bp, Homo sapiens
tgccggcattatcctcatttgtctaaaaagaaaatggaagcttagaaagaaacttgcttcatgttacacagtgaaagcctgaatccagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcacagccagactggcacagttttctgagaaagactattcaaacagtctcaggaaatcaaatatgcaaagcactgacttctaagtaaaaccacagcagttgaaaagactccaaagaaatgtaagggaaactgccagcaacgcaggcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttcagaa

SEQ ID NO: 289169 - DNA, 2252 bp, Homo sapiens
accgcccggagcagcggtgcaggacgcgcgtctccgccgcccgcggtgacttctgcctgcgctccttctctgaacgctcacttccgaggagacgccgacgatgaagacaccgtggaaggttcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttagtgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagagtaagagatgaggacctatacctattttataacctatttataagtggtttaagaaccttcttaattgtatctattctagaaaatacatatttttatttcc

SEQ ID NO: 289170 - DNA, 405 bp, Homo sapiens
ctgcagcacgccgagaaagaaaaaaatgtcaggcgatgacggcggaggaaggatgacttacccatgttgctccccgagggtggagtctcgctctgtcgcccaggctggagtgtaatggtgctatctcggctcactgcaagctctgcctcctgggttcacaccattctgctgcctcagcctcccgagtagctgggactacaggcgcccgccaccacgcctggctaattttttgtatttttagtagagaaggggtttctctgtgttagccaggatggtctccatctcctgacctcgtgatccacccgccttgtcctctcaaagtgctgggattacaggtgtgagccaccgcgcctggctggttccatgatgtaattttcaataaacatcattaacttgacccctgca

SEQ ID NO: 289171 - DNA, 1844 bp, Homo sapiens
tacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatcttcatgcagatggggaagaggtgacagcccttccccactggcctcccccgtggaggtggagtagacagatcccgggaaaggcaggaaaagggccttgctttctttccctgtttcctaagccgtggtcaccctagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgagtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcgctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccgtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccattgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggagga

SEQ ID NO: 289172 - DNA, 2149 bp, Homo sapiens
tacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatctctgcccagggctgtcctgacagcacagacgcttcagggagacaggcctggggacagtcatgtcatcacccttgcaacaaccacccaaaggaaaagagagcgctgaacagtttaggaaagggctcgcgtctaagacatcaagcgacatacagagatgtgcaaaacttggtgagaattaaaattgacctttgggagagggtaggggcaggatgttttatgacactgtagaaaagacaggaggaacccgctgcgatggagattggggggagctggaagcaagcagccaacaggacagagttccagaactcatgcagatggggaagaggtgacagcccttccccactggcctcccccgtggaggtggagtagacagatcccgggaaaggcaggaaaagggccttgctttctttccctgtttcctaagccgtggtcaccctagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgagtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcgctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccgtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccattgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggagga

SEQ ID NO: 289173 - DNA, 1821 bp, Homo sapiens
tacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatctctgcccagggctgtcctgacagcacagacgcttcagggagacagatcccgggaaaggcaggaaaagggccttgctttctttccctgtttcctaagccgtggtcaccctagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgagtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcgctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccgtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccattgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggagga

SEQ ID NO: 289174 - DNA, 2095 bp, Homo sapiens
tacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatctctgcccagggctgtcctgacagcacagacgcttcagggagacaggcctggggacagtcatgtcatcacccttgcaacaaccacccaaaggaaaagagagcgctgaacagtttaggaaagggctcgcgtctaagacatcaagcgacatacagagatgtgcaaatgacactgtagaaaagacaggaggaacccgctgcgatggagattggggggagctggaagcaagcagccaacaggacagagttccagaactcatgcagatggggaagaggtgacagcccttccccactggcctcccccgtggaggtggagtagacagatcccgggaaaggcaggaaaagggccttgctttctttccctgtttcctaagccgtggtcaccctagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgagtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcgctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccgtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccattgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggagga

SEQ ID NO: 289175 - DNA, 1258 bp, Homo sapiens
atctcggggttcagactctctgacctgaggtaggctccccaggggctgggagaggggtttgacggaatggaggatggaggacagcgggaagaagaaacgaggaggaatgcaacgtgtggggcggccgccaagagtgaaaatagagggaagcgccatgcaagtgctggaaagaagggggcaggtgggacgagccccacagccccctccacaaaaagaccacttccgggactcagtgctcctttgggggcaggctccgccagctctccgccactcagggctccggtcccacggtcggagtgcccgggacggagacggccagttctggcggccaggtccgacgctctagaatccagccccatttccctcccggccacgcccgtccggcggcctctcctgtcatattcagcccctactcacctggggaccccgggaggggcgcgagggcacctgcagggggagggcctaaggggtcaggggaagcccccggtgtggagggtacgacgggcgcttcccccagggtggacgcagcaggcagaggcccaggagcagggctccgcaacccgggccgggctgggggcacggcggggagtcggcactgcgtcgtggggctggacttgggcgacctgcgggcgaaagggagccaggaacagaaagaggagcgatgagcggccccgcccaccctaaggccccgccccagcccagtgccagccactcccatgcatgcaagccccttcctgaaggcccgaggcggtcaccggagcttaagccccgccgccagcggcgccaacctcccagatccaccccgccccgcagcccgcgctccacggcaagccccgccctctctaagctccgcctctcgcttcaagtaggcgccaccccgggatgggggcgcgccctgcctggtccggcacttcttccgcggcccaggctggggggctttggggccgtgggggccgaccctggtacctgcgtccgaccgggacgctctgcacctgcagccaggagtcatccacaggaccccgtgggtgtgctgacgatggtcgtcttgatgtcaccgatgatgctgggcgcctccctcagcacgtggtgcatgcgccgcatctcgttgcgcccctgtgcctgctctgccgactcccccatcagcgtgttctgttccccacgcgagtacaagttggccagcagctccgagaagatgaactccttggtctgagagcgggcaaagagggaaggagactgggacctgattgatgcttgtgct

SEQ ID NO: 289176 - DNA, 2260 bp, Homo sapiens
cccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattgggggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggtacgggcctcgaaa

SEQ ID NO: 289177 - DNA, 2338 bp, Homo sapiens
cccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgtgcgccgacggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggtacgggcctcgaaa

SEQ ID NO: 289178 - DNA, 1732 bp, Homo sapiens
cccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgctgaggaaggcgtgaggaccagaggccccgaggtcggccagacccgggggcctcgagggcacgtgaggtgagccaggctgggtcgccggcggatgggccggtctcccgaagggacggtgctcgggcgggcggggcgggcggggacgtggcaagggggctgggaggcgagggacggggggcc

SEQ ID NO: 289179 - DNA, 202 bp, Homo sapiens
cggccccagcggcacctccacgaagctcacggtccaggtgtgcctacgcttctgccgcatgaaggggtaccaggtactgctcacgggcccagaccagtgacccctgacctggacctaaagaccacactcaactcccaacactcggttgccaaacccagacaccggtttctgaacctccagcccgattcccaccccgacccca

SEQ ID NO: 289180 - DNA, 2623 bp, Homo sapiens
cccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattgggggtgaggcgggcgcgcgggacgggagtgagtcagggagccgccccctcgcgcccatcctcaccgcagccgtgtgcccgcagcccgggtcttctcgacggtgacggctgtctcggtgctgctgctgctgctcctggggctgctgcgtccgtgcgccgacggtgcggggcgctggggcagggcctgagggcggaccggtggtggggagctggagccccagaagggaacagagctaggaaggaactcctgggttcttaagggagcgaggctttgggtccacgcacaggatcgcgcgcgggatcgcaggtagagcaggacgctgcagcgggattggaccggctcggctgatgtctgctccctctctaggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggtacgggcctcgaaa

SEQ ID NO: 289181 - DNA, 2543 bp, Homo sapiens
cccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccagcgacccccacggccgctgggggctgggcgcgcacaacttctgccgtaacccagacggtgacgtgcagccgtggtgctacgtggctgagacagaggagggcatctactggcgctactgcgacatcccctcctgtcacatgccaggctacctgggatgctttgtggactcaggggcacccccagccctcagcggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgtgcgccgacggtgcggggcgctggggcagggcctgagggcggaccggtggtggggagctggagccccagaagggaacagagctaggaaggaactcctgggttcttaagggagcgaggctttgggtccacgcacaggatcgcgcgcgggatcgcaggtagagcaggacgctgcagcgggattggaccggctcggctgatgtctgctccctctctaggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggtacgggcctcgaaa

SEQ ID NO: 289182 - DNA, 2148 bp, Homo sapiens
cccctccacaccttcccacttgaaccggcaccgacctgagggagagggggccgggaagcgctggacgcccggggtcgggggaacgggcgtgggaggcgtctggacctgctgcctccgctccagtgctgggcggggcttcccggcctcccatggggggagggagagacccagggggagggacccacggagggatgcgaggcgggcaggagtcagcccgttggagacctgggcgagggagacgccgagagctaggctcagtgggagggggcgggcgtagaggctgaggcaccgcccagagctcgctgagacagagactgagaacgcccccggccagattccccccggagagacccgggtagggacagggacagagagacgcctctaggggcagaggccctgggaggcaaagacccccaggagagatttacccaccccagacggaaagcgcggctcagagtcggacgaggggagactgtcagaggacaacgccccctaggtctcctgggagaccccgaagcgaccccgggggcagcccgggccgtgtccgggcgagggtgacctatccttggttgagagcgatggggacacaagccctgcagggcttcctctttctcctcttcctcccgctgctgcagccgcgtggggcctcggctgggagcctgcacagtccaggcctgtccgaatgcttccaggtgaatggggctgactaccgcggccaccagaaccgcactggcccgcgcggggcgggccgcccgtgcctcttctgggaccagacgcagcaacacagctacagcagcgccacggccccagcggcacctccacgaagctcacggtccaggtgtgcctacgcttctgccgcatgaaggggtaccagctggcgggcgtggaggccggttacgcctgcttctgtggctctgaaagcgacctggcccggggacgcctggcccccgccaccgactgtgaccagatctgtttcggccaccctggacagctgtgtggcggcgatgggcggctgggcgtctatgaagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcgggctgcaggacgccgctgaggacccagaggcccccgagggctcggcccagacccccgcggcgcccctcgacggggccaacgtgagctgcagccccaggcctggggctccgccggccgcgattggggcccgggtcttctcgacggtgacggctgtctcggtgctgctgctgctgctcctggggctgctgcgtccgtgcgccgacggagctgtctgctggctccgggaaaagggcccccggcgctgggggcttccaggggccccaggagaagctgggctgtgtggtaccaacagccccgaggggtggccttgccctgctcccccggggacccccaggctgagggttctgccgcgggctaccggcctctgagtgcctccagccagagctccctgcgctcgctcatctccgctctctgactctgggccccgagggtccgctgggcccgccgccggcgagatggacacctgagatgctgtgctgcgccctgcctcggccttgcgcctgtgtaggggcagctcggcctctggtcgccttggggagaccaaaagtcggacaggaaacatctggtgctattatctgggacttggcctgaccgtgggggtccagatggtccaggccctctccatggacctgtatgtgggggtggtctctggtttcggaggtctttgaacccctctgggggtggtcctggactgccgtcctcagtgagaggtcacaggtcagcaaaaacagtcaaaaaacccccacagattttgaataaaggatctactttggtacgggcctcgaaa

SEQ ID NO: 289183 - DNA, 699 bp, Homo sapiens
ggagccgccgtgtcctggtcctcaggatgctgactgccggccccgcccgcagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcggtgagcctcagctcggcgcgccctgcccgctgttcccaccccgctctccccaccccgcctcacgcccctctccgcagggctgcaggacgccgctgaggacccagaggcccccgagggctcggcccagacccccgcggcgcccctcgacggggccaacgtgagctgcagccccaggcctggggctccgccggccgcgattgggggtgaggcgggcgcgcgggacgggagtgagtcagggagccgccccctcgcgcccatcctcaccgcagccgtgtgcccgcagcccgggtcttctcgacggtgacggctgtctc

SEQ ID NO: 289184 - DNA, 802 bp, Homo sapiens
caccaactctgttgtgtttgccttcattttcttaaggaaagtagttattgaccttctagttgcttatttctctaagctgttcttttattaatattccagaagcaatattgagatagatttatttcttatatacatgcaataactattattctcctaggttctgaaggagcttagactcatttaattggaattgttgaaatgttttaaattattcatcaaacatttatctagctgcgaggatattccaggcactctgttaaggtctagggatgtatacataactgagacatattattttctcttaagcaactcatggtacaatttgggaaaggaataaatgaacaattatggtattgtgctaaatagtattattttgataaatgccaggataaagtcaggctaaagatccccagcaagcacagggtagctcctaaatagctttatagccacttaaaatttcacatccataaagttttaaatatgtggtgggaattaagtgcttaatctgtagcactatatccgtttcctttgcaagaatatatttttgttcatcttattttggaaaaaaaagataccatattaaaatatcattttctgcagataaatgcaaatttaaaaaataaagcgtgttgaaaaactgttagaataaagattagattttataattatataaaatctttaccagtgatagttaattacttaatggtaatacttctaagaaaaattacctatagaattcagaaatagataagttggaatagtggatcttactgtgttttgttttcagggaaaataggataaa

SEQ ID NO: 289185 - DNA, 428 bp, Homo sapiens
tctccaagcgccaactatctttctctccaagccctggcctggctacctctccaagccccaggctgtccacctctccaagccccaactgtctacctctccaagccccggcctggctacctctccaagcccctggctacctctccatgcccggcctggctacctctcctcttgcctataggccctgaggggcaattccagcccaagggaatccatggctcctgctgctccaagaaaacctagttcatgttgtggctctgcagagcctggcctggtcttgtcctctgtgtttcacagaccttccgtagccagtcccacctgccctgctctctgctgcatgcgcaggggcctcctgtcagctcctcagagacccttattatcccagggctcgccatgcactgcctccttcgcctggagcctcttaccttcca

SEQ ID NO: 289186 - DNA, 595 bp, Homo sapiens
aatcttgctgctgctcactctttgggtccacactgcctttatgagctgtaacactcacggtgaaggtccgcagcttcactcctgagccggcgagaccacgaacccaccagaaggaagaaactccgaacatcagaaggaaccaactccggacatgccgcctttaagaactgtaacactcaccgcgaggagccacggcttcattctggaagtcagtgagaccgagaacccactgagtccggacacattaggatgttagagtcccaccttcaaagcatttttctcctggagtggactttgcacaaatggtaggccaattgtggagtcagtgaagaaccaggctaatccagcttgttttattggccccagtttttcttctcagggccgtaaaccagttattaccaggaaacaaaagcaaaactggagtgcagtggctcagtctcagctcactgcaacctctgcctcccagttcaagtaattctcctgcctcaggttcctgagtagctgcgactacagaggaccaagaacttcgctttattcctggcagtgtgcattgctcatggcagcatgaaaaaaacagagtcctgagtatgaagta

SEQ ID NO: 289187 - DNA, 565 bp, Homo sapiens
cccaccatttggcaagtcctaagttcttgtcctgcatccaggaagaatgaggtatgcggacaactggagggtgaacaaggtggaaaggagctttattgagtgacagaacagctcttgggagacccaaagtgggtggctcctatctgcaggcaggtcatcccagtgaatgtccagctctcagtggagaggagacccagagtgggcagctcctattcgcagagtcatgtggaagcaccaggatcccattcctaccactgaaattaaacaaatgaaaaaaaattagcatgaaattctttgtgcgtggacagtgacctgagaagacaataagacatttcaaagcattgagttaaggataatgaagtttataaaatctagtggcaagatatagctgactcttgacacagacagaggaaaggccatgtgagacacagcaagaaagtgaccatctgcaagccaggaaggagacgttttttggttttggttcctcaccaggaaccaaattaaatgccaccttgatcttggacttccaagcctccagaactgtgagaaataaatgtatgttgct

SEQ ID NO: 289188 - DNA, 398 bp, Homo sapiens
  misc_feature (17)..(17): n is a, c, g, or t
ttgggcgggggttgggngggcgtggtgttttgcgttgtttttatgttgcttgagtcatgtggaagcaccaggatcccattcctaccactgaaattaaacaaatgaaaaaaaattagcatgaaattctttgtgcgtggacagtgacctgagaagacaataagacatttcaaagcattgagttaaggataatgaagtttataaaatctagtggcaagatatagctgactcttgacacagacagaggaaaggccatgtgagacacagcaagaaagtgaccatctgcaagccaggaaggagacgttttttggttttggttcctcaccaggaaccaaattaaatgccaccttgatcttggacttccaagcctccagaactgtgagaaataaatgtatgttgct

SEQ ID NO: 289189 - DNA, 1364 bp, Homo sapiens
  misc_feature (1345)..(1345): n is a, c, g, or t
aacagtactgtattttcacccacctccccgaactcagctttatttgtgctagaagaggtgattttattcaactagttaatttcagtgcaggttgctgtaaacaggaaataatatgttatttatcatagtaagacaaaaaaaatttgaagtgaatgacttgttgggtctatgcaaacacctcatcctacctcagaagcaatcctaagaaattaatacttacttagctttctttttaggaaggccctaatacaaggcatctttctgtttttttgttttgttttgttttgttttgttttttgagtgttacagcctggactggccagcaagacagaaatttcttcttcctaaaaatgtgtaatgtcaaataaccattatcaaccctatctatgttaatgttcgcacactcatgaatggggaaatgtagggctcatggtaataaatcaataatgacaacaatgaacatttaagtccttattatgtgtcaaatagtttacattaattaactcggttctcacaacaacctaagaagtaataatggttagccactaaatatgataatgtagaagaaaataatggaaagtaaataaataatgtgaaatctataagatacacatccatgatctcacatccccaaaagtagctgtacctttttcagtttttttccttttacttccctggaatttgtaaatatcttttcagctctaaacagctaatacaataaacacttttaatctattttggcaggcactgtttttggtactatgggggacacaggaatgagtaagagaggtcctaaattccatgctgatactacatattgctgataatcagatcaatttcataaagtattacagttctggccatatagaaagggttctagttttatctatgaaatttctcttaattgtctatagcactgatacaatcttacaaagctgcctatgacatcttatcttgcacatgcactgcagcaagaaggctgatgctcagtatgtggaacgtctggagtgatcatctcaaagcctttgtcacataacttgctgagttttctgatattctgatagtagttataagatgcctgagtaactcatgaaatcttatggatttttatctcactttatagatttaatgacctccaccatctctaagaacaagcagctatttctgtagagaaagatcatctttggataacaatacatgattttaggctctaaaagttaaaacgtgtttgtaacgttgatattatgcagaggtcttgacagaacttggcagtctctgaggctacagagaagtgtgaaaaagagcatagagatttcagaaggaggcagattcagtcagacgtacntcggccacgaccacgctaa

SEQ ID NO: 289190 - DNA, 546 bp, Homo sapiens
  misc_feature (527)..(527): n is a, c, g, or t
ggttatggggtggctgtttttctacgtggaccaagcagggtcccagttcaagtttctgctgcctatctgataatcttgaggtatttatgaaggactcctttgaaagttctctactgagtttccttaaggaattggaatattattcagtccaggtttaagtccttcagcatctgacattctcctggcaactgtaattgaatcaatgatgactcatctgagatgagcaagttggtccagtcagaccaaacaaaagacattctataatcaggggagaagtcttctctatatctctcttatatgagcaaatttaatgacctccaccatctctaagaacaagcagctatttctgtagagaaagatcatctttggataacaatacatgattttaggctctaaaagttaaaacgtgtttgtaacgttgatattatgcagaggtcttgacagaacttggcagtctctgaggctacagagaagtgtgaaaaagagcatagagatttcagaaggaggcagattcagtcagacgtacntcggccacgaccacgctaa

SEQ ID NO: 289191 - DNA, 227 bp, Homo sapiens
cattctgtgggtggtggtgcatgcatgacttggtggggaaacttaaagatgcttcgaaaagcctggaaagagcaactcagttgtaacttggggaagttaacgatccgcccagtatgggggcacgaaggctcatcattcaaaataaaacaaaataaaaaagtattaaggcgaagattaaaaaaattttgcattacataattacacgacagctatgtatcacctcccga

SEQ ID NO: 289192 - DNA, 913 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289193 - DNA, 2242 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289194 - DNA, 1325 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaaggatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289195 - DNA, 2350 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaaggtacaggatttatttaaatatccatttattttcaaatactaccttaatgatttcaatttcagttttaaaaatggagacagaactttggctttttttttctttcttctacacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289196 - DNA, 2801 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaaggtacaggatttatttaaatatccatttattttcaaatactaccttaatgatttcaatttcagttttaaaaatggagacagaactttggctttttttttctttcttctacacttatctagaagactgtaaatttgacagagagcgaatagaactgttttgcacggaatatcaggttacttactttaaaatttttaattaacagtactatttttcttttactttgtttgtaaagatgtttttttttctttctttcttgctttcttttttctctccagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289197 - DNA, 2693 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcaggttacttactttaaaatttttaattaacagtactatttttcttttactttgtttgtaaagatgtttttttttctttctttcttgctttcttttttctctccagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289198 - DNA, 1210 bp, Homo sapiens
gtaggatccccgtgacagcactgcgctaacaatggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcaggttacttactttaaaatttttaattaacagtactatttttcttttactttgtttgtaaagatgtttttttttctttctttcttgctttcttttttctctccagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289199 - DNA, 1085 bp, Homo sapiens
  misc_feature (889)..(889): n is a, c, g, or t
  misc_feature (891)..(891): n is a, c, g, or t
  misc_feature (968)..(968): n is a, c, g, or t
  misc_feature (971)..(972): n is a, c, g, or t
aaggctagtagaggccggtgttgaatcggccgagaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaaaaaaaaaaaaaaaaactcgagtttntntttttttttttttttttttttttttttttttttttttttttttttttttttatttattttttttttttttttttttnttnnccccccctaaatttttttttaaaagggtttccccccccttttaaaaaaccccccttgggcgggggtggaaaaaacaaatgttttctggcccagaaaggggtcccaaaaatcta

SEQ ID NO: 289200 - DNA, 2682 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaaggtaaagtttaagaaacttctctagcgggggatttagggaacttcttaaaacctagagttaaaagctgttgcgtgtttgttgtgttattttagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289201 - DNA, 3144 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaaggtaaagtttaagaaacttctctagcgggggatttagggaacttcttaaaacctagagttaaaagctgttgcgtgtttgttgtgttattttagaccaatcaacttcataggatgtacagacctgcatatttggtgaccttaagtgtacaggtatttatagataagtcttatccaataatgaaatttataatttcattgatttaaataaacagcgtttcttgttgcgtgttttttttcctgccctagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaaaaaaaaaaaagaaaaagagagtaaaaaaaagcaaacacaacaataaaaacaaacaaaaacacacaaacacacaaaaccacaacaagaaacgaacacaaaaagagggcgggcgcgcagccatgcataatcaccacgcaccgccgaggacgacgcgacacaagacaagcagacaccgcacacaccattgtatcaatagaagcgcgcacgccagcacagaagcgcataatcatgacaaaaagacgaacacgcgcgcgccgaataaaacacaacaaacgacaaggagagagagcacacaacacacagcagaacatgtagagagaaaccaacacagtacgggaagaaaactactgacaaacccaaaccaac

SEQ ID NO: 289202 - DNA, 2950 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaaggtaaagtttaagaaacttctctagcgggggatttagggaacttcttaaaacctagagttaaaagctgttgcgtgtttgttgtgttattttagaccaatcaacttcataggatgtacagacctgcatatttggtgaccttaagtgtacaggtatttatagataagtcttatccaataatgaaatttataatttcattgatttaaataaacagcgtttcttgttgcgtgttttttttcctgccctagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaaagacaacacgaaaagagcacaaagaacagcaaaaaaaaagagaacaaaacaacgaaaacgaacaaaagaaaaagaaagacacaaaaaagagggggggcgggcccacaaaaagcccccggggggcgcaccaaagaagcgacgaccccccgtacggaaaaggggccgccccaga

SEQ ID NO: 289203 - DNA, 864 bp, Homo sapiens
aaggctagtagaggccggtgttgaatcggccgagaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289204 - DNA, 1900 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289205 - DNA, 834 bp, Homo sapiens
tggcggcagaggatccccgtcggatgcaaggtcctcggatgcaaggtccgcggacgccaggggacgaggccggttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289206 - DNA, 2590 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289207 - DNA, 1364 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcaggttacttactttaaaatttttaattaacagtactatttttcttttactttgtttgtaaagatgtttttttttctttctttcttgctttcttttttctctccagaataataagaattccctagaaatcctactgggaagaggtaggtactgtataaggtgtcaagctgaggcacttttcacttgcaggtatgaatggagagtgttggtgtgaaacaagatcttcgggatcttgacccaaagaaaaggagccaaagggcatgtcaagcaattgaagttaagctcatgtttttaaagatcgtttattgagatgattttgaaatgctcctttaccattcataatttaaaaataaagtttaacaatggtttaaattcagaatggattaaaatggagttgggggtggaaagtagagccattcttagtaaatataaataactgaaaagttcttctgaggagactatgtacgaagttatcattgcatctttcagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289208 - DNA, 3163 bp, Homo sapiens
gtacaggaagagaaaaagagagagaaagagagaagaatcaaatagacaccagaaacaatgatgaatggtcaacttcgacgtacaacgccttcacgcttctcctccgggcggcattccagagtctgctggacgcccaggcggacgaggccgtgttagggtaagccgctcggctcggctcggagctggatccgccggggtggaggggcgctcggagaagaggagccggcggagcgagaaggggaaagccccgggaagaggaagtctccgggctttgcccttcgctccggacggagtgttggggacgtggctctgccaggactcggagcagactctgagcattgttttggccccacttggcacctgcatagagccaactccacgttcctggcccggtttccctcccagtctctttgttcttttgtaaagccggtgttcaagtcttgtttgtggcctaaacatctaaggtgtttagccttgtctgaggctgcggctgttttgacagttggacttcatctggggagctccctgcaattcaagcttccagggctaggctagcaaaggtttaagggtctgtttccgaagtaattactaggtcagacagtgttgacatttgccaacttagagcatacctcaagttgctatgatcactccagcgctctagttcagcatgtttacacaggttctacgcctagaaccttaaactatgatgcacaatactttgttccgccccagttaccaggatgcgagtgtcttttaagcgatccggtcagtgactgcggaggtgcagtgtcagtatggattgaagacatattttaagaccgatcgcttttagatgattttcttaaatataaatatcccaacaattcaaatttttgttttttttctgtagtttcatgaactaaacacttgtacaaaaagtatgaaagtggaagttcttaaacgaaaatagtaaccaccacctgggttaatctcaaaaaaaaaatgactgtcaaaccctgaaagtactaatataatttggaaatttgtatcttatattctgaactcatgccctaccttctacccccttgatgtatttgttcatggagccggttaccctaaactcatcatttttaggatggaagtttattctaaaattgacacaatgtaaaatatttatcttgtttttcctttgaatttactccagtgttagaatgaccattgcattgttatattttctttgggggctataatattttttaatagtaaaaatattaaggcaaaataagttaattgaagctagtaatagtagagttcttgttgtgttctttttattgtttttcacttgatcttgttgctcatctcatttacttataattgactgtccttatagttgatgtttttaatctgtgttaaagggtttttaaacccaaattaaaatatcctttttggaacatgactgtaaagaatttattatcataggcatcactggaagttaatttattttagatcatccagacttgaaacatatcgacccagtggttttaaaacattgtcatgcagcagctgcaacttacatactagaggcaggaaagcaccgagctgacaagtcaactctaagcacttatctagaagactgtaaatttgacagagagcgaatagaactgttttgcacggaatatcagaataataagaattccctagaaatcctactgggaagtataggcagatctctccctcatataacggatgtttcttggcgcttggaatatcagataaagaccaatcaacttcataggatgtacagacctgcatatttggtgaccttaagtgtacagaacactgattccccatcctatccagagattagttttagttgcagcatggaacaattacaggtacagtattaggatctataaatattcctgtctttttataaatgtttacttgagagttatactcttgggaagttcaaaagaaaattaatctaaccatttgtcagcagataatgaagattggttaaggatttaatgggaaaggggcatcaaaagtagtattttaagataggcttcacttgaaattaagatgttattaatagagaattggtctgtatttgctgttcttgctgattgaaataaacttctgtagtgtttagtgtaaatttcttctattcatgatgagtttggtccaataagataaacaaaattaagagcatggctttgaaaatgtctttgctttcagaaattgaattaaactgtcaaaattggattttgaaactttttaaatgactttataaagggggaagtatacataacattctaaaactgtttatattgcccatttaagactgggaaaattcaaaactacatttattagtggatatgacaacgaatttatttcatagtttttaaaaaatgaagctcattactggaaatttaagtgaaattgaatttttcaaaggcatcttctgcagagtcgttttaatgtaactatgaatcaaactttcaactttcagaaaatgtgtatacagcataacctttgttagataacttgagaaaattcagatgtatctgggcggttaaggatccggttagaaatcatgtttcagtgtgagggcaaataaccgatttgaacatgaggtatttccgaggaaacgctttttttgcccgatagtagtttgtcaaaagttaaaatcttgttgaattttaaacttgtttgggaaggtgtgtcctgattttttttcttgcatctttcttgagcttggatacttctttccatgttttatcctaaaaacgtggtattgtatacacgtcttttaggacttggtggggaaacttaaagatgcttcgaaaagcctggaaagagcaactcagttgtaacttggggaagttaacgatccgcccgagtgcagaggaaaaccagaaacgccttgccttcagctgaaccaccgtttgtgcgagctggatgtccttttcagtagaaaagaattttccttttgaatttataccattcatcaattttgacactttaaaaacgtgtgaaagggttaagagggaaagatactgcccaagtatttgaatcgtttagtagtaactgtccatttatcctattttgatctttttcaagtcttctgaaaggaagtagacagtattacaccctgaataaataaggtgttgttttccacaaa

SEQ ID NO: 289209 - DNA, 443 bp, Homo sapiens
gattatttagtttcctgcttggggaaatgttcacacccccttgtggatacattgtccagcccagagtttgtcctccctggatatgttttgaattaatgacggccgcacctcctttcctgtatttatttggaattgcctggtggaaggaggactctgctgcactcactgactgtgtgatctttggtaaatatcttaccctctctgggcttagtttccctagtggtaaagtggaaatagtgataactatcttagatagctgttgtgatgcccacatgagatagcatctggctttacccttccctcgtctggcaataacggttaccttgcaggattggcagaagccttagagtatggtgctttgcagatgttcaccgtgtgattaatgtggttgagttccatgagagaaatggtctactgtctccctttcaggctgcccttctccg

SEQ ID NO: 289210 - DNA, 819 bp, Homo sapiens
gctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaagtaagttctgaaggattcctttcatgcggtgaaggaacaacaacaatattcaacttcaccttgttgctgtctaacattcaccggaaacctctccataaacaaggagaaacgaatgcacacgcatttttgctaagaagcccgggattaagatttaaggatacaagctgaaagaaaaaatgaaaaatgcttctccgcgcgtcaatcgaggggtggatgcgccacgcagctgagcccagctcacagccacgcgtaagaccaaaagctgccatgggttctgcgcgcggagacctcagagccgaagagagaagtccccgcgtcagaaacgctgcggatgccaggtcttgaaaatgctgacttctgaggctaagaattatttcaaagacaaaaagaaaagactggtgaggaggccttccggtgcaagggcgcctatccgctaattttggatggggaagtagggattattcgtttaaattcaatcgcgagcaccaagtcggactggccggggatggagaagggcaacccccacctttagaaaaataaaagatctcgaaggcc

SEQ ID NO: 289211 - DNA, 756 bp, Homo sapiens
gctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaattgctgtctaacattcaccggaaacctctccataaacaaggagaaacgaatgcacacgcatttttgctaagaagcccgggattaagatttaaggatacaagctgaaagaaaaaatgaaaaatgcttctccgcgcgtcaatcgaggggtggatgcgccacgcagctgagcccagctcacagccacgcgtaagaccaaaagctgccatgggttctgcgcgcggagacctcagagccgaagagagaagtccccgcgtcagaaacgctgcggatgccaggtcttgaaaatgctgacttctgaggctaagaattatttcaaagacaaaaagaaaagactggtgaggaggccttccggtgcaagggcgcctatccgctaattttggatggggaagtagggattattcgtttaaattcaatcgcgagcaccaagtcggactggccggggatggagaagggcaacccccacctttagaaaaataaaagatctcgaaggcc

SEQ ID NO: 289212 - DNA, 292 bp, Homo sapiens
aaaaatatctttatttctggattggctttgattgctgtgattttaggacacggactatagttgtagatgttgccctggctgcgtatcaacaatgacttcttttccttgatgtttcttcacaggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacaga

SEQ ID NO: 289213 - DNA, 1337 bp, Homo sapiens
  misc_feature (40)..(40): n is a, c, g, or t
tacctcttccaaattcgaattgtgaattgatagatccacnggaaaatccaaccacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaagtaggggctctgtggctattactctctgagaccttggaatatggggtccagggtggaggggggcagggtatgccacttagatccagctgaattcaggagcccctggcttcagattggttgaaagccctcaaggacttctcattttccagatcagtcttatgtgcaattcaacatttcgtagagatgagagtagatgatgaaccatgctaataataacagcaaacttgtttatagctctgttgccaggcatgctactaagggctttacatatatgttagtttgcttaatcccaacaactccatatgatggttattgttattatccccaatttatagatgaggaaactgaggcatatctctctcacacacacacacacacacacacacacacactcacactcacacacccctagtaaatagtagagctggaattcaaacccacagtctggctgcagggtctatatttttaaccatttcaccaaactgtctttaattagaagaaataatgatgttgaggccattatatctaaatccctgtctaggtagctgctaaggtctatttcttctacatttag

SEQ ID NO: 289214 - DNA, 1069 bp, Homo sapiens
cagatctgcgtagaaacgggtggcggggaagagaggggaggagagctctgagtgggaagcggagccgggggcctgggacccgtcgcgtcagagccaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaagaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacaga

SEQ ID NO: 289215 - DNA, 1473 bp, Homo sapiens
cagatctgcgtagaaacgggtggcggggaagagaggggaggagagctctgagtgggaagcggagccgggggcctgggacccgtcgcgtcagagccaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacacgcagcaccaaggaccagcaattcaagtaggggctctgtggctattactctctgagaccttggaatatggggtccagggtggaggggggcagggtatgccacttagatccagctgaattcaggagcccctggcttcagattggttgaaagccctcaaggacttctcattttccagatcagtcttatgtgcaattcaacatttcgtagagatgagagtagatgatgaaccatgctaataataacagcaaacttgtttatagctctgttgccaggcatgctactaagggctttacatatatgttagtttgcttaatcccaacaactccatatgatggttattgttattatccccaatttatagatgaggaaactgaggcatatctctctcacacacacacacacacacacacacacacactcacactcacacacccctagtaaatagtagagctggaattcaaacccacagtctggctgcagggtctatatttttaaccatttcaccaaactgtctttaattagaagaaataatgatgttgaggccattatatctaaatccctgtctaggtagctgctaaggtctatttcttctacatttag

SEQ ID NO: 289216 - DNA, 396 bp, Homo sapiens
gaaagtgagtccttggaaaagcaaggggtcactgtggctggggagagcagagattgaacgaggaggtggtactagggccacagtgtgaggaatgatgagggtctgataggtggcaatgcagggagaaggtgttgtttggggagggaactgcctgggcaaaggtaagatggcgggaaagcttgtctggggagaaatgggggaggtaagggcgccaggggccagcagagaggaaaagagaagaggtggatagaggccaaaggctgtagactggaattaacgggtggatcttcactcaagccctgggatacagaagcctgaagttagtggttatcaggcatctagggcctcacatcttctgtcgtcttaaattgtgccgtgagaatcttcatggacgct

SEQ ID NO: 289217 - DNA, 1218 bp, Homo sapiens
gctctggagattgcatcccacgcaggcagcccccttccgtacaagagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacggaactgtgccttcgatctccacagtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccccgtggttggttttcgtccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccg

SEQ ID NO: 289218 - DNA, 1269 bp, Homo sapiens
gtggctcacgtctgtactcccagagccttgggaggtcgaggcgggaagatcgcttgagcccgggagctcgagaccagacgcggcaacatggcgagacgcacatctctgcctttaaaaatgagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccccgtggttggttttcgtccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccg

SEQ ID NO: 289219 - DNA, 1195 bp, Homo sapiens
catgatacgaatcgaggctataccccctaagcggtcatggcgacgggcactgggcggacgcgtttcgaggaccccgggcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccccgtggttggttttcgtccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccg

SEQ ID NO: 289220 - DNA, 1318 bp, Homo sapiens
gctctggagattgcatcccacgcaggcagcccccttccgtacaagtaaagtggtctcgctgagaaattttctaagtgctggtttctctttgcgggaccgactcgccgcccccaaatatcccatttggatcccattctgtttcaggagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacggaactgtgccttcgatctccacagtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccccgtggttggttttcgtccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccg

SEQ ID NO: 289221 - DNA, 1194 bp, Homo sapiens
gctctggagattgcatcccacgcaggcagcccccttccgtacaagagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccccgtggttggttttcgtccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccg

SEQ ID NO: 289222 - DNA, 1206 bp, Homo sapiens
agttttagccaaccgggatcagcttagattgtgggcgtccaaccccagccaacagggagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccccgtggttggttttcgtccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccg

SEQ ID NO: 289223 - DNA, 480 bp, Homo sapiens
ggagaaagtcttgctctgtcacccaggttagagtgcagtggcacaatcacggctcacagaagccttgacttcccgggcttaggtgattctcccacctcagcatcctgagcagctgggaccacaggaatacaccgcacaccaccatgcccaactaattttctttttgtattttttgtagagatgggatttcaccatgatgtccaggctggtctagaactcctgagctcaagcaatccaccctccttggcctcccaaagtgctaatattacaggcgtcagctaccgcatatggccaattttctaaattcttaaatgcgattctttggcagtgttgttttgtgaccaaaaataaaatggttcctagaaataaacacatcacctatttcataataaaaaggaggaataataattcgatctacagatacttgtgattctcatctaccccgaaaacgagatcattgcatacattaaatagcatatc

SEQ ID NO: 289224 - DNA, 480 bp, Homo sapiens
aagtcccagctcctttgaatctgaggacacccttctccatgaacaatgcatcagcaagtctttcagattctgtctccaaagtcaatcacaaatccatcttcttctctccatctccagtgccactcctttgaaggttatgattacctctggcttagactattacaacacctcccaaatgagatgggatttcaccatgatgtccaggctggtctagaactcctgagctcaagcaatccaccctccttggcctcccaaagtgctaatattacaggcgtcagctaccgcatatggccaattttctaaattcttaaatgcgattctttggcagtgttgttttgtgaccaaaaataaaatggttcctagaaataaacacatcacctatttcataataaaaaggaggaataataattcgatctacagatacttgtgattctcatctaccccgaaaacgagatcattgcatacattaaatagcatatc

SEQ ID NO: 289225 - DNA, 1508 bp, Homo sapiens
  misc_feature (676)..(676): n is a, c, g, or t
cttgtcgccctggacctcacagctgctggaagagcacacagagcgagcaccccgcatcagccaggagtttggggagcggatggcccactgctgcctaggcgggctggcagagttcctgcagagcttccagcagcgtgtggagcgattccatgagaacccagcagtccgggagatgctacctgacacctatatcagcaagaccatcgccctggtcaactgcggccccccactgagagctctggccgagcgcctggcccgggtggggcccccagaaagcgagccggcccgggaagcatctgctagtgctctggaccatgtgacccggctctgccaccgtgtcgtggccaacctgctgttccaggagctgcagccacacttcaacaagctgatgcgccggaagtggctgagcagcccggaggccctggatggcatcgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcggcgcaactgcagaggctgttccggcggctggagtcccaggcctcgtggctggatgcngtggtgccccatttggctgaagtcatgcagctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctgtgccccgcccatctttctgtctcagcctccctctcttcctgggccgcctccccctctcccggctggccaggcccagtttggcctgtctgcctcggccccggcctccgtctctagcgcgacctcgggcccagcgctgagggtcacccaaccgccggccttagtgaccccatctatgctgctgacaagccaacctcccgtacggcgcccctcctgactccctgcctgggaccacacacccctgggatagaaagacccttagatgtcttttcacccaaccccaaactccctgtacagaagggaaacaaacgccaggcacggtggctcatgcctgtaatcccaacactttgggaggctgaggccggaggattgcttgagcccaggagttcaagaccagcctgggcaacatagtgagacctgccccctatctctacaaaaaataaaaaattagctgggcacggtggtgtgtgcctgtagtcccagctactggtgaggctgaggctggaggatcactggagttcgaggctgcagtgagctatgactgtgccactgcactccagcctggtcaacaaagcaagaccctttctc

SEQ ID NO: 289226 - DNA, 1396 bp, Homo sapiens
  misc_feature (564)..(564): n is a, c, g, or t
ggcacgagggtggagtgaaagttacaccgtggcggattgacttctaaggactcttggtacatgaggaagaaacccggaaggggaagaggaaagcaaaggcgtcaggaatggttcttcctcagagctctggccgagcgcctggcccgggtggggcccccagaaagcgagccggcccgggaagcatctgctagtgctctggaccatgtgacccggctctgccaccgtgtcgtggccaacctgctgttccaggagctgcagccacacttcaacaagctgatgcgccggaagtggctgagcagcccggaggccctggatggcatcgtgggcacgctgggtgcccaggccctggccctgcgcagaatgcaggacgagccttaccaggcgctggtagccgagctacaccggcgggcgctggtcgagtacgtgcggcccctgctccgtgggcgcctgcgctgcagctcggcgcggacccgcagccgcgtggccggcaggctccgggaggacgcggcgcaactgcagaggctgttccggcggctggagtcccaggcctcgtggctggatgcngtggtgccccatttggctgaagtcatgcagctggaagacacgcccagcatccaggtggaggtgggagtgttggtgcgcgactacccagacatcaggcagaagcacgtggcagccctcctcgacatccgtggcctgcgcaacacagccgcccgccaggagatcctggccgtggcccgggacctggaactctctgaggagggagccctgtcaccccctcgggaccgtgccttctttgcagacatccctgtgccccgcccatctttctgtctcagcctccctctcttcctgggccgcctccccctctcccggctggccaggcccagtttggcctgtctgcctcggccccggcctccgtctctagcgcgacctcgggcccagcgctgagggtcacccaaccgccggccttagtgaccccatctatgctgctgacaagccaacctcccgtacggcgcccctcctgactccctgcctgggaccacacacccctgggatagaaagacccttagatgtcttttcacccaaccccaaactccctgtacagaagggaaacaaacgccaggcacggtggctcatgcctgtaatcccaacactttgggaggctgaggccggaggattgcttgagcccaggagttcaagaccagcctgggcaacatagtgagacctgccccctatctctacaaaaaataaaaaattagctgggcacggtggtgtgtgcctgtagtcccagctactggtgaggctgaggctggaggatcactggagttcgaggctgcagtgagctatgactgtgccactgcactccagcctggtcaacaaagcaagaccctttctc

SEQ ID NO: 289227 - DNA, 782 bp, Homo sapiens
gaaagctcagggcccttgttcactagaagcaaggagtcccctgacccccttcttcaaaacatactcttcagtctttgtctttattcccgccttggtcctcctttgttcagtccagcaaggtccacagcaaagtgctgcccgaaaacagggtcttgaggacatgaacaaagaaggtctgctggagcagaggaagtgaaattgaccagatgaacagggaccctgggatgaatctgctggcagtggatataaggggcaaagccaggatctgaacccagacggcccggctccggagtccatgctcctgagcaccacacagtgctgctcccttggaaattcagaaaggctggacccagtgctccagggcagcaggaggagggcacatgccaaggatgtcactggaaagggagcagaggtgaggctgtgaagcctttatacccaagagaaactcagctggacaccagtaacagaagtgctattcattgaaaagagcaaagcaagagcgctgaccccttacggacaggatgaaacaaaacaagctctgcaagtctgcctcctgctcagcatacaggcttgttgccccactgggccatcttgttgttgatgggcatcttgcagaactgatcagacttgaatagccatggagctcctaaaaagaatgggacctttcacttgacctcccttctctcccttgcctactgcccctgagcgagtgcttcagctacagtctgggagccgaagatgcctgtgtttgatgcctccagcaccctgtctctgcatcttga

SEQ ID NO: 289228 - DNA, 484 bp, Homo sapiens
tacccactctcagggcttgggcatgaacctacagcccttgaactcagttggggagtagggaaatgccagtatcgcagcgattcaattcatatcttgatgattctccacatatcctttttcccttttagcctttatacccaagagaaactcagctggacaccagtaacagaagtgctattcattgaaaagagcaaagcaagagcgctgaccccttacggacaggatgaaacaaaacaagctctgcaagtctgcctcctgctcagcatacaggcttgttgccccactgggccatcttgttgttgatgggcatcttgcagaactgatcagacttgaatagccatggagctcctaaaaagaatgggacctttcacttgacctcccttctctcccttgcctactgcccctgagcgagtgcttcagctacagtctgggagccgaagatgcctgtgtttgatgcctccagcaccctgtctctgcatcttga

SEQ ID NO: 289229 - DNA, 1992 bp, Homo sapiens
cactacgcccggctaatttttttgtattttttgtagagatggggtttcaccgtgttagccaggatgatctcggtctcctgacctcgtgatccgcccgtctcggcctcccaaagtgctgggattacaggcatgagccaccgcgcccagctgttttgcatttttgtatgatttccatccttcactttatgaaggacattatttatcacattaatgatcaaatatatttatcacaataatgataatagaaaattaaatatttacatttttgtatgtgtgtcttttgggagaaagatacatattctgcattatcttactagtatgaagccttctttatctatgtctgctgattgtgtacacctcggtgccagacataaggaaaaccagcataggccccagagcctgatgtgtaagttctggtcccagatccatcgaaggccatttaaagtctctgaaaatccactctctcatatgtaaaatgtgatcattaagaattgttatgcctacctcataaagttttggttagaatcacatgagatacatgtgaaaatgctttgtcaactaagaacgtgttacacaaagacaagatatgtattattatggttattttctatttctctagtttgactagtttcattctttgcaggacattttcatttttagatgttcttagctattttgcctgtggtgatcagaaggcagatgaaccatggggttctatttctctgactctagatccttttaaaaagctggtgacctttttgtctttcttttcttgttttatcgtttttttttttttttttttgaaaagtggaaaaatattctcagggtatattgaattgattgagcctcccttggatttctttgacttatttgacttactctatatcttgcttctttactcctctaatttaacattttcctctaaaccatcatcagaatgtttttgcactatcattattcatttttttcagttacagaatgtgggaaaaaggagagaagggggctgttgaagaggaggcttcatagaataatgaatctggaagaattcaaggagaaagcgtgtttgttgtggttcacgttaaaagagagagatcgttgcagaaactgtatgctgagcccttatctgggtcgatcacagcaccagctttctctattcttggcctggttgttatgagaaagttgctcatctgggctggctgttcccgaccaaaatttatgctgatgacctcaactaggacctttctgaagtgcaataatatttttagccttttctaactgtccatgaatcatccatagctttccactgtccttagacactacccctaccatcgtcactgtctgcctcttctcaccttgcagcccgagttctactgaatccagaaaacccacttacaatcctgtaccacaatctgtcttccttttctttctcattaatattcttgaggtctagttccattttttaaaataaatgttttattttagaatattttagatttacagaaaagttacaaagatagtacaagacactcctatgtaccccacagctggttgccactattattatcttacattagtatggtacacttgtcacaattaatgatccaatattgatatgctattattaactagaatccatgctttatcatatttccttagtttttgcctgttttttcccttccgggatttaatattacatttagtggtcatgtgtccttaggctcccctgacttgtgacaatttctctgactctgtttttgatgaccatgacagttttgaggaatatcgatcaggtattttgtagaatggcctctgttgtgattttcctgatgtttttctaattataagcttcgggttgtgggtttgcgggaggaagatcacaaaagtaaagaaccattttcatcaaaagacatacggtgagcacgacttaccactactggtgttgacctggatgaactggctgaggtcgtacttgccaagtttctccaccataca

SEQ ID NO: 289230 - DNA, 419 bp, Homo sapiens
cagctccccggcacgggcccgccgtcagcacgtcacgtcaccgcccgggagagagacccaggaaaatgcggaagggtagacaggccccctcctccgcccgagcttgggagcctgtgaaatgtaagactggtgtcatcgtttcataaatcatgaattttccacattccttaatagagaggagcccaattgggtccttgagccagaaacgatagaaggcctttcaatcatttttccagagaaagattagtcagaaaagaagctgttgattttcactccacatcggagactgatgggaattcaaataagaagcaataaattattggcttatgagaaaatgtagaccttcttgaataaagttgtggtaattctttttttttttttgtatcccaaacattaaaaaatatttatcttcccctaga

SEQ ID NO: 289231 - DNA, 1072 bp, Homo sapiens
tgcctgctgcgtccaccctgggggaagcgcccgtcgtaccctccacaccgggggcttcccctgaccccttaggccctccccctgcaggtgccctcgcgcccctcccggggtccccagggacagtggattcggggccccggcctccctggaatgagagatgcacagactgggccgtgatctcccaccgtgtcctcacagccccaagacagaatgccatgcggattggcaggagacctcactgtggggttcttggagccaaccctccaggccatgtagggtccagccctacgggacttagtgggtgttctccccgtgtgcggagacgagagattgtaataaataaagacacaagacaaagagataaagggaaaacagctgggcccaggggaccactaccatcaagacgcggagaccggtagtggccccaaacagctgcgcccgctgatatttattgcatgcaagacaagggggcagggtaaggagggtgaatcttctaagtgattgacaaggtgaagcaagtcacgtgatcacagaacagggggcccttccctcttaggtagccgaagcagggagagagaaggcagcatacgtcagcgttttcttctatgcacttataagaaagatcaaagactttaagactttcactattccttctaccactgtctactacaaacttcaaagaggaaccaggagtacaggaggaacatgaaagtggacaaggagcgtgaccattgaagcacagcaccacagggaggggtttaggcctccggatgactgcgggcaggcctggatactatccagcctcccacaagaagctggtggagcagagtgttccctgactcctccaaggaaagggagactccctttcgcggtctgctaagtaacgggtgccttcccagacactggcgttaccacttgaccaaggagccctcaagcggaccttatgcgggcatgacagggctcacctcttgccttctacatcacttctcacaatgtcccttcagcacctgaccctatacccgcaggttattcctaggttatattagtaattaaaagctaatgattaataatg

SEQ ID NO: 289232 - DNA, 643 bp, Homo sapiens
gggcttttcaatggacggggtgttgaagcagccagatggtaaggtcttcctgatgtcctccagattgcgaatgtccttcatgatctcctcgatatctcggttatagtccatgatggcagcctcctgcttcttggcttcattctccagggtttcgctctgttgcccagggtggagtgcagtggcacgataacagctcactatcacctcaaactcaagtgatgcacctgcttcagtctcccgggtagctaggactacaggcgtgtagcaccacacccagctaatttttaaaataatttgaagagacgagatactgccagcaagatgagttaagaaaaatcactgtttagttgtacaatgatactggaccataaatgctaccctagctggcaatatatcttcaaaatataaaaagaaactcctcagaccacagtgttctacttagggcaaggtccacagaaggcacctaatgaaaatgacccacactgagggactatgttttctggcagcagtgaacgacggcctcttctttgccactgaaagtgagcaagtaaccacaagttcgtgtatgtcattaccgtgattgctacacccaactggaaaaagaatattcctactgtgactccattaaagtcttttcaaagca

SEQ ID NO: 289233 - DNA, 698 bp, Homo sapiens
tgttctttttcgttttttaaattgagacagggtttcgctctgttgcccagggtggagtgcagtggcacgataacagctcactatcacctcaaactcaagtgatgcacctgcttcagtctcccgggtagctaggactacaggcgtgtagcaccacacccagctaatttttaaaataatttgaagagacgaggtgagatctcgctatgttgcctaggctggtctcaaactcctggcctcaagctatcctccttgcatggcttcttaaagtactgggattaccagtgtgagccatcacacccagcctgtgattctactattcttttattctactattgaaatcctttactttaaatcccttaaagatactgccagcaagatgagttaagaaaaatcactgtttagttgtacaatgatactggaccataaatgctaccctagctggcaatatatcttcaaaatataaaaagaaactcctcagaccacagtgttctacttagggcaaggtccacagaaggcacctaatgaaaatgacccacactgagggactatgttttctggcagcagtgaacgacggcctcttctttgccactgaaagtgagcaagtaaccacaagttcgtgtatgtcattaccgtgattgctacacccaactggaaaaagaatattcctactgtgactccattaaagtcttttcaaagca

SEQ ID NO: 289234 - DNA, 1754 bp, Homo sapiens
gaaatatcttttaataagatatgcaatgcaaggaacaatcaatggattattttttatatgtttggggatggaaaatggaagggaagaaagtatacctgttatttttcctcagtgccagccatataaattgtacatttttcactagcaaggaataaaaagtcattttcctttaaaaataataaattgcctagggacatttgtggattgtgagtgtcttaaaaatgaaaacactaaatatttattaactggacaatggattgtttctttccagactacatcaaagaatcagagaattatctagccctacatttaacagcatgtcttaaactctttctagaccatccacaatattgtttgaacatctgaagacatggggaacttgccatctgatatctgataacagacttcctgtaaagcaggactggtagtttcctgataacaaattcttcaatatgaaggatatagctgtgtcctttacaactggtagcatggaaagaaagagaagtctgcaaagattgaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagcagataaaaatagaatggaagataacataagactaatatcaaaattctaatgttgatactgtgtaggattgcactgaagtaattttaaattggttcttaaggaactcttaaaaagtcccttaaaaatattaaattgttgcaccttacaaacagtggaaaagaaaaaaaaagtatttggaatgttacacacacacacagaggaaatgtattaggtctatcatcaattatggtctttgtttatgaccttcaaaaagctttataaagaaaaaatttaagtgccaatgtagtgaaagaaagttaaaaattcctaaagacgcaagtctgagtgcatttaccaggtctaagaatatatttaaaggttgggggcaaggcatgattgatgcacatttaagaagaaaaatatggaacccataaggtaggtcaagttctttggagagtgttgagaatgaagatgtattaaactctggctatcttggaggagattccaaagtacatggagttctccagctctttatcagttgaaatctgtttcatcgtggccaatagataattaagactaacttttcagcaaactgatttctcctatattcaaacacaaaaatctttaccacacgttcagagctgatattctataacagcacaaataagaatcctggtttacaaaggaaaccacattagcaaggatttttttttttcccatgggttcttaaccaaatgtctgaagctgctagacatctgcaaagaggggataagtttagatttcctactgattttggaagaaaaatattttcctaaggaagccagagtcatccatgagcagggacctgtcttcaggaatctaagaagcataatgtccttaatgcttacactcatgacaag

SEQ ID NO: 289235 - DNA, 1245 bp, Homo sapiens
gactttcttttttttttttttgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagcagataaaaatagaatggaagataacataagactaatatcaaaattctaatgttgatactgtgtaggattgcactgaagtaattttaaattggttcttaaggaactcttaaaaagtcccttaaaaatattaaattgttgcaccttacaaacagtggaaaagaaaaaaaaagtatttggaatgttacacacacacacagaggaaatgtattaggtctatcatcaattatggtctttgtttatgaccttcaaaaagctttataaagaaaaaatttaagtgccaatgtagtgaaagaaagttaaaaattcctaaagacgcaagtctgagtgcatttaccaggtctaagaatatatttaaaggttgggggcaaggcatgattgatgcacatttaagaagaaaaatatggaacccataaggtaggtcaagttctttggagagtgttgagaatgaagatgtattaaactctggctatcttggaggagattccaaagtacatggagttctccagctctttatcagttgaaatctgtttcatcgtggccaatagataattaagactaacttttcagcaaactgatttctcctatattcaaacacaaaaatctttaccacacgttcagagctgatattctataacagcacaaataagaatcctggtttacaaaggaaaccacattagcaaggatttttttttttcccatgggttcttaaccaaatgtctgaagctgctagacatctgcaaagaggggataagtttagatttcctactgattttggaagaaaaatattttcctaaggaagccagagtcatccatgagcagggacctgtcttcaggaatctaagaagcataatgtccttaatgcttacactcatgacaag

SEQ ID NO: 289236 - DNA, 1700 bp, Homo sapiens
gaaatatcttttaataagatatgcaatgcaaggaacaatcaatggattattttttatatgtttggggatggaaaatggaagggaagaaagtatacctgttatttttcctcagtgccagccatataaattgtacatttttcactagcaaggaataaaaagtcattttcctttaaaaataataaattgcctagggacatttgtggattgtgagtgtcttaaaaatgaaaacactaaatatttattaactggacaatggattgtttctttccagactacatcaaagaatcagagaattatctagccctacatttaacagcatgtcttaaactctttctagaccatccacaatattgtttgaacatctgaagacatggggaacttgccatctgatatctgataacagacttcctgtaaagcaggactggtagtttcctgataacaaattcttcaatatgaaggatatagctgtgtcctttacaactggtagcatggaaagaaagagaagtctgcaaagattgaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagcagataaaaatagaatggaagataacataagaaaattggttcttaaggaactcttaaaaagtcccttaaaaatattaaattgttgcaccttacaaacagtggaaaagaaaaaaaaagtatttggaatgttacacacacacacagaggaaatgtattaggtctatcatcaattatggtctttgtttatgaccttcaaaaagctttataaagaaaaaatttaagtgccaatgtagtgaaagaaagttaaaaattcctaaagacgcaagtctgagtgcatttaccaggtctaagaatatatttaaaggttgggggcaaggcatgattgatgcacatttaagaagaaaaatatggaacccataaggtaggtcaagttctttggagagtgttgagaatgaagatgtattaaactctggctatcttggaggagattccaaagtacatggagttctccagctctttatcagttgaaatctgtttcatcgtggccaatagataattaagactaacttttcagcaaactgatttctcctatattcaaacacaaaaatctttaccacacgttcagagctgatattctataacagcacaaataagaatcctggtttacaaaggaaaccacattagcaaggatttttttttttcccatgggttcttaaccaaatgtctgaagctgctagacatctgcaaagaggggataagtttagatttcctactgattttggaagaaaaatattttcctaaggaagccagagtcatccatgagcagggacctgtcttcaggaatctaagaagcataatgtccttaatgcttacactcatgacaag

SEQ ID NO: 289237 - DNA, 1207 bp, Homo sapiens
gaaatatcttttaataagatatgcaatgcaaggaacaatcaatggattattttttatatgtttggggatggaaaatggaagggaagaaagtatacctgttatttttcctcagtgccagccatataaattgtacatttttcactagcaaggaataaaaagtcattttcctttaaaaataataaattgcctagggacatttgtggattgtgagtgtcttaaaaatgaaaacactaaatatttattaactggacaatggattgtttctttccagactacatcaaagaatcagagaattatctagccctacatttaacagcatgtcttaaactctttctagaccatccacaatattgtttgaacatctgaagacatggggaacttgccatctgatatctgataacagacttcctgtaaagcaggactggtagtttcctgataacaaattcttcaatatgaaggatatagctgtgtcctttacaactggtagcatggaaagaaagagaagtctgcaaagattgaacaaacagcatgcactgtggtatcctttatttaaaaattgtgagctgactacagttgtagtgttctcatttaccattctgatggcataataaaccaagagaacattaacacaattccaagaaggcattaacctgtaacacacatatacgccacacatgcacacacacaacatacacgcacacaaaggttatattctgaacacaaaagtgatagaaaaaagctttgaatgcgctaaatcaaataaaaaccctttattataataaactgtggcaatactgtggctatcatgaaaaatattgtaactattttaaaagcaaaaggaaaaatactggcagtttgaaactagcagcaaaaagcagataaaaatagaatggaagataacataagaaaattggttcttaaggaactcttaaaaagtcccttaaaaatattaaattgttgcaccttacaaacagtggaaaagaaaaaaaaagtatttggaatgttacacacacacacagaggaaatgtattaggtctatcatcaattatggtctttgtttatgaccttcaaaaagctttataaagaaaaaatttaagtgccaatgtagtgaaagaaagttaaaaattcctaaagacgcaagtctgagtgcatttaccaggtctaagaatatatttaaaggttgctgtgccgaattcctgcagcccgg

SEQ ID NO: 289238 - DNA, 841 bp, Homo sapiens
gactacatcaaagaatcagagaattatctagccctacatttaacagcatgtcttaaactctttctagaccatccacaatattgtttgaacatctgaagacatggggaacttgccatctgatatctgataacagacttcctgtaaagcaggactggtagtttcctgataacaaattcttcaatatgaaggtatggataaagcatttggctgccaataatgaactgcaccaaagtcaccaattcaaaccatgccctggtaaatagtatcatcagtgatgatgatgatgatgatgatgatgatgataatgtcacatgttaaaaatgtcatatagattttagcatcttgaggacctgatactctgtaacagtggtccctaacctttttggcaccagggaccactttcatggaagacagtttttccatggaccaggagagggggtggttttgggattattcaagcacattacatgtattgtgcattttatttctattattattacattgtaataatatattttattataatataaaataagtatacaactcatcataatgtagaatcagtggaagccctgagcttgttttcctgcaactagactgtcccatctaggggtgatgggagacagtgacagatcatcaggtgttagattctcataaggagcgtgaaacctagatccctcacatgagcagttcacaatagagttcgttcctgagagaacctgatgccgccgctgatctgacaggaggcagagctcaggcggtaatgcgagcaatggggatcggctgtaaatatagatgatgctttgctcacttgcccactgctaacctccttatgtgtgac

SEQ ID NO: 289239 - DNA, 1917 bp, Homo sapiens
cctactggtagatcttcacagactggatgttaagcaagtggaaaggcagaacagcctccactcgcggtgcacggggaagagtgggcggcggacgtggttttgggcctgggacccaggtgttcctctaggcccagggcgggcatcgctgcccatccgtcccacaggtggttctgaggcgtctctcaacagccatatggcggacaccagaacccgggtgtaacagtgacccgtttctgtgtgggtccccactcccagggagggcaggagagcgccgggggcgtaacccccctcccccacgctggcaccagagtgtgagcagaatcggcttaaggcagctcccagtccccatcgcccccaaggtcgaaagaatcgggacaggaaatgggtcgggggaccgagtttgggccggaatgttcagagcgtgtccgtcctgctctttaaagcccctctctccatcccagaaccaaagccgggcgcccccagcgctcgctgcggtctcgcgcccgggtaacggccgatggccgcccccgccccagccgcagccggggaggaaatcccgcgcctcggaagaggcgcttcgggctcgggcgggttccggaagccgaggggccgggagtaggtgggcgcataggggctcctgggaggcgggaccaagacgcgcgttaccgggaggccaggcccggcgctgcaccctccgcggcccggggcctgaggccgggctcccgcgacttcccggcccaaagcagcgcagcgcccgggcggcccagccccgcagcggccacagcagcatagccgggcgagcggatccagaggcccgggcttccttcctgtgcgagtcggcgcggacgactgctagtccagccgttgggcgccgcctggatctcggcgcctggcccttaaagagacccggtcgcatttcatctcagcgagaggagaaatactcgaagggagaggttcgccgctggcagccagaagccttaccactgctaggacgctggcagaacgcacccataacttggcaacactcggaggatggatggcaaataataccagcgactgaagggttaattaatgattgcagattaattgaacaccttccgtaatcagacacctggcacacactcatgatgtcacttattcctcccaacaaccctgcaaatagataactgtctctcccattctccgagcttgtcctcagagaattaggtaacttgttcaaaatggtcagaagcaacagatataactccttgctctactctttccccccttctcactactgcacttgactagtctttttaaaacataatttttttggccaggcacggtggctcacgcctgtaatcccagcactttgggaggccaaggaaggcagatcacctgaggccagaagttcgagaccagccttggccaacatggcgaaaccccatcgctactaaaaatgcaaaaattagctgggtgtggtggggggcacccgtattcccagctactcagaggctgaggcaggaaaatcgcttgaacctggaggcagagattgcagtgagccgagatcattgcattgcactccagcttgagcaacagagggacacttcgttccccccgccaaaaaaaaaattttttttttaatgatcagaagcggctgggcgcggtggctcgggcctgtaatcccagcactttcggaggccgaggaaggtagatcacttgaggtcatgagttcaagaccagcctgaccaacatggccaaaaactgtctctactaaaaatacaaaaattagccgggcgtggtagcgcacgcctgtaatcccagctactcaggaggctcaggcacgagaatcgcttgagtctgggaggcggaggttgcagtgagctgagatcgtggccactgcaatccagcctgggcgatagagtgagactacgtctc

SEQ ID NO: 289240 - DNA, 1158 bp, Homo sapiens
ttcctctctccaacgaagtcttatattttaccattctgcgtgtattagaaagctaaatttaaacagcaacaataagaaatcttccccagtggatccctcgagcctttcgggaaaatgcaggtttctggctgacaggaagaagaaacagcatccaatcggcacttgtgtctcaatgaccaatcaaatttcgccttacattgcatcgctgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtaatgtactcccttaaccaggaaattaaagcattctcccggaataatctcaggaagcaatgcaccagggtgacaacgctaactggaaagaaaattatagaaacatggaaagatgccagaattcatgttgtggaagaagtagagccgagcagtgggggtggttgtggttatgtgcaggaccttagctcggacctgcaagttggcgttattaagccatggttgctcctagggtcacaagatgctgctcatgatttggatacactgaaaaagaataagaatgttttgaatttattgaagaagcaaaaagaaaagatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaattcccttttttctcttgccttttttatgcataaatggaggtcaatttgattgtcctgacctactgtataagtaaatttcaaatgtcattactttctctttgttattataatgtgtgattaaatgcttttttaaattgctaagggaaaaaaa

SEQ ID NO: 289241 - DNA, 1276 bp, Homo sapiens
ttcctctctccaacgaagtcttatattttaccattctgcgtgtattagaaagctaaatttaaacagcaacaataagaaatcttccccagtggatccctcgagcctttcgggaaaatgcaggtttctggctgacaggaagaagaaacagcatccaatcggcacttgtgtctcaatgaccaatcaaatttcgccttacattgcatcgctgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtaatgtactcccttaaccaggaaattaaagcattctcccggaataatctcaggaagcaatgcaccagggtgacaacgctaactggaaagaaaattatagaaacatggaaagatgccagaattcatgttgtggaagaagtagagccgagcagtgggggtggttgtggttatgtgcaggaccttagctcggacctgcaagttggcgttattaagccatggttgctcctagggtcacaagatgctgctcatgatttggatacactgaaaaagaataaggtgactcatattcttaatgttgcatatggagttgaaaatgctttcctcagtgactttacatataagagcatttctatattggatctgcctgaaaccaacatcctgtcttattttccagaatgttttgaatttattgaagaagcaaaaagaaaagatggagtggttcttgttcattgtaatgcaggcgtttccagggctgctgcaattgtaataggtttcctgatgaattctgaacaaacctcatttaccagtgctttttctttggtgaaaaatgcaagaccttccatatgtccaaattctggcttcatggagcagcttcgtacatatcaagagggcaaagaaagcaataagtgtgacagaatacaggagaacagttcatgagttgcattgtagcagacaatggacaactgtagtttctgaattgacttctatagccatcttttcccttttttggagagtagactagcaaaattcccttttttctcttgccttttttatgcataaatggaggtcaatttgattgtcctgacctactgtataagtaaatttcaaatgtcattactttctctttgttattataatgtgtgattaaatgcttttttaaattgctaagggaaaaaaa

SEQ ID NO: 289242 - DNA, 375 bp, Homo sapiens
agcggtaagtggccgagcctgggctgtgtgtggctttttgcgatgagcagaaagaagtaaatgtacttgacatagtgtttactctccagctggacctgtgcaaatgacctggtcttaggatacagttttttgttagatgtaatggattttcacctcagccccacattggggccctggcatcaagggctctctagttactagccagcatttcctttcatcctggcattttccagacgtgaagagaaacatctcgaatctttatcattgcagttttactgtgaaagaattgatctttttttttttttttaagagctagtgtcaggacttggagttggcagtccgcaggctgtgtttaatttttgtgactatgggtgg

SEQ ID NO: 289243 - DNA, 657 bp, Homo sapiens
tgtagagatgagatcttgcttatgttgcccaggttggtcttgaactcctcagctatagcagtcctcccacctcagcttcccaaagtgttgggattataggtgtaagccaccacacctggccacttatttatttttcttttttctttttttttttttttgagatggagtctcactctgtcacccaggctggaaatctctaaaacagtggtgctcaacttgcctggctgttcaatcttgcctttcttcctggataaaggagagaatgaggccacttggtagtggtcaagccctggggaccaagccttccatggaggggttcttggtaagttttaggttgtattacctgccctttaagcaggagtgaattacagtaacccatgcctttgtaaatgcctagaatttacaggattccgatgagcgcttcctgaatgcacagtgttctccagggcagttgattttttaacttagtctaaggcagtggttctcagctgggggtaattctgcccaccagggcacgcttggcaactactgaagacatttttgactgtcatgatcaacactagattgtgtagttgcatccagtgggcagaagccagggatgctactaaacatcctatagcccctcacagaaaaaaaataacctggccaaacacgata

SEQ ID NO: 289244 - DNA, 940 bp, Homo sapiens
tgcagagcatccctgtgccccgcggatatagactggcgcgcctctgttgcgcaggcgcagaactacaacttcagggttttccccaacggcctcttttttgcacgttaggagaaactacatttcccataatcctttgttccagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttc

SEQ ID NO: 289245 - DNA, 986 bp, Homo sapiens
accaagcgatgccccgccggcccagcggctacttcttgtcttctggaggcgccggcagtggctccggtagagccttgggcgagggctcgggctcccagagcaggaattcgtggagcagcgtgttgaccgtctcagggcattccagcatcaccatgtggctgccctcgtcgatgagcttcaggaatgccaggagcaggatctgcagaagacgcagggctcaaggagagaatgaggccacttggtagtggtcaagccctggggaccaagccttccatggaggggttcttgggctggagcggctctgggctccggaatcgcccgcagccggtactgcgggacccactgcggatatggctgtcttggctggatccctgttgggccccacgagtaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttc

SEQ ID NO: 289246 - DNA, 1176 bp, Homo sapiens
accaagcgatgccccgccggcccagcggctacttcttgtcttctggaggcgccggcagtggctccggtagagccttgggcgagggctcgggctcccagagcaggaattcgtggagcagcgtgttgaccgtctcagggcattccagcatcaccatgtggctgccctcgtcgatgagcttcaggaatgccaggagcaggatctgcagaagacgcagggctcaaggagagaatgaggccacttggtagtggtcaagccctggggaccaagccttccatggaggggttcttgggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttcacacacacacaacaaaaaccccgggcccaatccgggggccgggacacacgggatgcacggggcccggcaaagggtcccgcgacccctttg

SEQ ID NO: 289247 - DNA, 1161 bp, Homo sapiens
accaagcgatgccccgccggcccagcggctacttcttgtcttctggaggcgccggcagtggctccggtagagccttgggcgagggctcgggctcccagagcaggaattcgtggagcagcgtgttgaccgtctcagggcattccagcatcaccatgtggctgccctcgtcgatgagcttcaggaatgccaggagcaggatctgcagaagacgcagggctcaaggagagaatgaggccacttggtagtggtcaagccctggggaccaagccttccatggaggggttcttgggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttcttacaaaaaaaaaatctccgggggaccgacaaggcaactcaagggggcggaccttgcctagaggaacaccgcgga

SEQ ID NO: 289248 - DNA, 1020 bp, Homo sapiens
accaagcgatgccccgccggcccagcggctacttcttgtcttctggaggcgccggcagtggctccggtagagccttgggcgagggctcgggctcccagagcaggaattcgtggagcagcgtgttgaccgtctcagggcattccagcatcaccatgtggctgccctcgtcgatgagcttcaggaatgccaggagcaggatctgcagaagacgcagggctcaaggagagaatgaggccacttggtagtggtcaagccctggggaccaagccttccatggaggggttcttgggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagctta

SEQ ID NO: 289249 - DNA, 712 bp, Homo sapiens
ccagcgccccgtctgacctttctcgccgtccctctacccacgcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaa

SEQ ID NO: 289250 - DNA, 1086 bp, Homo sapiens
accaagcgatgccccgccggcccagcggctacttcttgtcttctggaggcgccggcagtggctccggtagagccttgggcgagggctcgggctcccagagcaggaattcgtggagcagcgtgttgaccgtctcagggcattccagcatcaccatgtggctgccctcgtcgatgagcttcaggaatgccaggagcaggatctgcagaagacgcagggctcaaggagagaatgaggccacttggtagtggtcaagccctggggaccaagccttccatggaggggttcttgggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttc

SEQ ID NO: 289251 - DNA, 874 bp, Homo sapiens
attgtcgaggtgtctagggcctggagatgggaccagctgcctgcctgccccctaccccaggttgggcgccgctaagggctggagcggctctgggctccggaatcgcccgcagccggtactgcgggacccactgcggatatggctgtcttggctggatccctgttgggccccacgagtaggtcggcagcgttgctgggtggcaggtggctccagccccgggcctggctggggttcccagacgcctggggcctccccaccccgcagcaggcccggggcaaggctcgcgggaatgagtatcagccgagcaacatcaaacgcaagaacaagcacggctgggtccggcgcctgagcacgccggccggcgtgcaggtcatccttcgccgaatgctcaagggccgcaagtcgctgagccattgaggatcgcgacgcagtcggcgggaccctcatggaagcatcgccctcgcctcggaccttgcctggcgctatttttgcagggagctggggagcaggaacgcctcggacctgagtgctctccatattgtggggttgaagtctggatgggagcttgccaagtccctttttaggctttttaattaggaagcatttcgaacctgcgcaacagaccaaagaacagtacaaagaacatccgtgtacccagtaccctgactaccgactacctacaacccgtccctgccccatcctgagttcttttgaagctgatctcaggcatcggattatttcttctgtaaatatttcagaatgtatctctccaagatgagagctcattaaaagacaattacaaagcttatcacatccaaaagaattatcaataattttgaaatattattaaacgtgtaataaatgttcaaagttc

SEQ ID NO: 289252 - DNA, 818 bp, Homo sapiens
accgtcagatcgcgtgagaattcagttactatcacgagaacaacacgggaaaactgtccccataatcaagtcatttctctccctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggtgtctgtgcggtgcagaaactgtacaactgtatacagtgaccatttctactctgggtctctaaacaagggctggtatcgttacagagactgaagactgaggaagaccatctctgtaggatgccaaggattgactggagaaagtctggaattttccacaaatgagttcatttataaagagaaaggcaagctttgatgacaacaccttcacaaaatggaggcctttgaaaacattggtctggattgaggagttggagaagaatgaagtgcacatcaaccaaacagaagagaagcaatttggaggaggaaaaaatcagttcttcatgaaaggatcacattgatcttggggttcatcccagtgcctcctctgcagacaatcttgtcctcagtctttcaattgttttcttccc

SEQ ID NO: 289253 - DNA, 867 bp, Homo sapiens
accgtcagatcgcgtgagaattcagttactatcacgagaacaacacgggaaaactgtccccataatcaagtcatttctctccctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggactctccagaactctaagatgtcagaacaaactttgggacatagctggtcttgtagcaaaggatacaaagaatagacgaactacacctggctcttcgagtgtctgatagaagaaacacaccttacccacagccatgttacattggccaaaacaggtcacgtggccacacttggggccagtgaagtagagaaggataatatttctacagaaaagggataccacagggaggagcagccaacattttgaacagaaatataatctgctatataggacatttcataaagtaggtcaaatatttttggaaaaaaaaaagaggggagtctatgtatggtcagttaagtttaggaactcctacataatacccatctctagagctatgcaatgtaaaccagcacaccgaaggctctcagaagtcctgcaatagaaaaataaaatcaagattgtttaaccccaagtt

SEQ ID NO: 289254 - DNA, 646 bp, Homo sapiens
accgtcagatcgcgtgagaattcagttactatcacgagaacaacacgggaaaactgtccccataatcaagtcatttctctccctaacaagtgaggattacaattcaagatgaggtttgggtaggaacacaaagcctgaccctatcccacagcatgtccaggctgccctagcaccacccaatagaagggaaaatggcagagggaaagtcctagtggaaagagacctcagtctcagctaattgtggtgacaatatattgcttttgcaaattgtacataaacatatgaccaggtgaatgtatcgccaaggctcctgccaaggcctgggatggaggcctagagaagatgcccgaaagtttatgctgtgtgagcttcacagaagacctgccttccatgtatacccattttacaggtaagaaatttagggatttgccagcttctaaggaacaccacattccttacaccatactgaggtacaatttgaagagttgcggtatacgcactgtttcgtgaggaaaaacggagtttctgtaacaaagcaagagctttaaaaatatgttagcaatatttgaccaggccataacccagcttggggcacctgactgctgtctgtgctgtcaagaataaatttttcttatctgttgtataa

SEQ ID NO: 289255 - DNA, 502 bp, Homo sapiens
cttcctctaggtttccacagagcagcttcaggcattcatcttggtgagcagtgtgcaagctggattttcctaaccacttgctctcttcctcaggtgtctgtgcggtgcagaaactgtacaactgtatacagtgaccatttctactctgggtctctaaacaagggctggtatcgttacagagactgaagactgaggaagaccatctctgtaggatgccaaggattgactggagaaagtctggaattttccacaaatgagttcatttataaagagaaaggcaagctttgatgacaacaccttcacaaaatggaggcctttgaaaacattggtctggattgaggagttggagaagaatgaagtgcacatcaaccaaacagaagagaagcaatttggaggaggaaaaaatcagttcttcatgaaaggatcacattgatcttggggttcatcccagtgcctcctctgcagacaatcttgtcctcagtctttcaattgttttcttccc

SEQ ID NO: 289256 - DNA, 924 bp, Homo sapiens
gcggccgcgacccggtcgggcgcctgcgaccaatgggctcgcggaagccgggcggagcgagggcctggccaatgcggagctgcgctgccccgagcagcccaatagacgcaggagccgcggatttgccgtcccgcccaccccgcctaccacgagagcagtgctgcggcgagtgcggggcgagaggttcgcgctggtggagcaccccagcttgcaggttcagcgtgggtgtctctcccgggcacatcgagctgtctagaggaaccctcttcccctggcttcacggcccagaggacgcacggctctctcccctcgagagcgtgtttcgtcgcccgcgcggggaacgcaaagtgctagggtagtcacggccacttcacgccgagggacatctcatctcgccctccaggtcgtgagcgcacccattccgctcactgaggccgaaagcttcggacctccgtgggccctgagacttcagcgttccatgtctgctgtgctgtggaacccagagtgctcttgcctggatggctgagaatcccttggaccctggaagcacctactccatgatggcccgcaggaggaccaaactggagacagtcctggctctgaggaaacaggaaggaaggagggtgaaaggaacgtccacctgcacacaaaggaaagatgaaaaagagtcacctaccatgggacctggcaaagtacttcagaacttttattccttccagaagcagtgtatcacaatagattgaatcaagaagtgacattaaggccagcgcggtggctcacgcctgtaatcccaccactttgggaggccgaggcgggcggatcacgagatcaggagatcagaccatcctggctaacatggtgaaccccatgtctactaacaatacaaaattagccgggcatggtggcgggcgcctgtagtcccag

SEQ ID NO: 289257 - DNA, 597 bp, Homo sapiens
ccacagtagcgatcacatagtatcctagaagtgagatggtaaatgcagtataatatttatgtaaatgaggggcagggcagtgagtctaaaaggatgtggatgctcacatctgctcttacaatcatgctacagttcatttattgagtggaaacagttccctacttattgacaattcatttactgaataggtaatcagtaaatacattttgtatcaatctaacaattaggcataaactacagcctcctacacccaatatctgaggtgttctaagatttaactactcaaatgtttgatatttgataaattgtttaagttctctgcaattcagttccacctcctataacagcacttctgaaaatgtggtctgtgaacctctgaggggttcctgagacactgtcagggagcaagtgagacatggctatttttataatattaaactattagcctttgtcactgtgttgtcatttacctaggataggtacaactgctggcacctgagcacagatcaaggcactgaccctaagctctactagttgttattgcatttttcaccactgtacactcataatttaggagaaaagagcaaaaactctaga

SEQ ID NO: 289258 - DNA, 594 bp, Homo sapiens
atagttatgaagctaagtcctaggccaggaacaaggcagccagtccagccagcatagttgacccctctatggactggggccagtgcagccacagcattccagtgctcagcccctcagctgggagatcagcgactgctgccacgtgcccagaaatggctcgtcctttcactacagcggaatgcaatgagggtgggtgagaagatgatgggtcggttatttcattccttttctttttacaacttcactttcagagacttcagcgttccatgtctgctgtgctgtggaacccagagtgctcttgcctggatggctgagaatcccttggaccctggaagcacctactccatgatggcccgcaggaggaccaaactggagacagtcctggctctgaggaaacaggaaggaaggagggtgaaaggaacgtccacctgcacacaaaggtaactgtcctctactcagggaagagtgaaccaggacaaagtaactgttttagagagcaaggcagctctctgggctgaaaaatgttaacagttaaagaccttgctaagtcaaagtctgcccctatctctgccctctcctgcttctaggtgacca

SEQ ID NO: 289259 - DNA, 370 bp, Homo sapiens
atagttatgaagctaagtcctaggccaggaacaaggcagccagtccagccagcatagttgacccctctatggactggggccagtgcagccacagcattccagtgctcagcccttggaccacttccccttcagcaggaggaccaaactggagacagtcctggctctgaggaaacaggaaggaaggagggtgaaaggaacgtccacctgcacacaaaggtaactgtcctctactcagggaagagtgaaccaggacaaagtaactgttttagagagcaaggcagctctctgggctgaaaaatgttaacagttaaagaccttgctaagtcaaagtctgcccctatctctgccctctcctgcttctaggtgacca

SEQ ID NO: 289260 - DNA, 1398 bp, Homo sapiens
gcggccgcgacccggtcgggcgcctgcgaccaatgggctcgcggaagccgggcggagcgagggcctggccaatgcggagctgcgctgccccgagcagcccaatagacgcaggagccgcggatttgccgtcccgcccaccccgcctaccacgagagcagtgctgcggcgagtgcggggcgagaggttcgcgctggtggagcaccccagcttgcaggttcagcgtgggtgtctctcccgggcacatcgagctgtctagaggaaccctcttcccctggcttcacggcccagaggacgcacggctctctcccctcgagagcgtgtttcgtcgcccgcgcggggaacgcaaagtgctagggtagtcacggccacttcacgccgagggacatctcatctcgccctccaggtcgtgagcgcacccattccgctcactgaggccgaaagcttcggacctccgtgggccctgagacttcagcgttccatgtctgctgtgctgtggaacccagagtgctcttgcctggatggctgagaatcccttggaccctggaagcacctactccatgatggcccgcaggaggaccaaactggagacagtcctggctctgaggaaacaggaaggaaggagggtgaaaggaacgtccacctgcacacaaaggaaagatgaaaaagagtcacctaccatgggacctggcaaagtacttcagaacttttattccttccagaagcaggtaagtaccccaagtcctcatcgtattcccagcatagggcttggtatacggggggatatttcattcagcatattggctgaatgaaaggtctgataggtatacctgggagaaggtccttagggacatggcttaaaaaatgagagaggggcagggcagtgagtctaaaaggatgtggatgctcacatctgctcttacaatcatgctacagttcatttattgagtggaaacagttccctacttattgacaattcatttactgaataggtaatcagtaaatacattttgtatcaatctaacaattaggcataaactacagcctcctacacccaatatctgaggtgttctaagatttaactactcaaatgtttgatatttgataaattgtttaagttctctgcaattcagttccacctcctataacagcacttctgaaaatgtggtctgtgaacctctgaggggttcctgagacactgtcagggagcaagtgagacatggctatttttataatattaaactattagcctttgtcactgtgttgtcatttacctaggataggtacaactgctggcacctgagcacagatcaaggcactgaccctaagctctactagttgttattgcatttttcaccactgtacactcataatttaggagaaaagagcaaaaactctaga

SEQ ID NO: 289261 - DNA, 319 bp, Homo sapiens
gaactttggatacctggtacatttggatagggtgggaggccacaaacttggctccatagacttggccgtctgtccatctcacttggaccacttccccttcagcaggaggaccaaactggagacagtcctggctctgaggaaacaggaaggaaggagggtgaaaggaacgtccacctgcacacaaaggtaactgtcctctactcagggaagagtgaaccaggacaaagtaactgttttagagagcaaggcagctctctgggctgaaaaatgttaacagttaaagaccttgctaagtcaaagtctgcccctatctctgccc

SEQ ID NO: 289262 - DNA, 597 bp, Homo sapiens
gcggccgcgacccggtcgggcgcctgcgaccaatgggctcgcggaagccgggcggagcgagggcctggccaatgcggagctgcgctgccccgagcagcccaatagacgcaggagccgcggatttgccgtcccgcccaccccgcctaccacgagagcagtgctgcggcgagtgcggggcgagaggttcgcgctggtggagcaccccagcttgcaggttcagcgtgggtgtctctcccgggcacatcgagctgtctagaggaaccctcttcccctggcttcacggcccagaggacgcacggctctctcccctcgagagcgtgtttcgtcgcccgcgcggggaacgcaaagtgctagggtagtcacggccacttcacgccgagggacatctcatctcgccctccaggtcgtgagcgcacccattccgctcactgaggccgaaagcttcggacctccgtgggccctggtgggtaagggggcacgggggtgagcgttaagagactcgtagaacatttttagtccgcgcgtggcacaaggcctccaagccccacgtacactttgcagccctcccactcctttttcattcctgcggctgagccc

SEQ ID NO: 289263 - DNA, 827 bp, Homo sapiens
ataacatctggtgtaaacacttgtggagctggttggagattctccggggacccttccgtatctgcctaggcatttgctgtctcctcctaatacgtttgataatcttatggcggagaaggaagctgtatcttcaaaatgtgtcaatttggctaaagagaatcaagtttttcaacaggagttatctatgaaaaaagcacaacaggaatgtgaaaaatttgaggaggataaaagatgttggaagaagaaatattaaatcttaagacacatatggaaaacagtatggtagaacttagtaaactacaagaatataaatcagagctagatgaaagggcaatgcaggcagtagaaaaattagacgaaatacatttacagatcgaataagaaaatagcaatgatcagtatcagctctttatggagaaagagcaggtgaaatattttctcagcactcttcctgcaaggcgaggtcgagagtcaccttgtgttgaaaatcttactagtataggactcaacgaaaatatattccccaaatgcccgtaagaattcctacttcaagcctcagacttcaaataattgccagaactacttgactgaggttagttatatgaccgtttctctttagggtttcatttctctagcgtaattcttgtttataatttggtgaaatactgagttgttctgttgacttttgcatgtgaagtaaagatcataattagctgtgttaacacagaaaggaaatgggaactttacattttttaattccctggagctctcattttcaagagatatccatttgctaactttattcaataaatgtgactaaactgaga

SEQ ID NO: 289264 - DNA, 1082 bp, Homo sapiens
ataacatctggtgtaaacacttgtggagctggttggagattctccggggacccttccgtatctgcctaggcatttgctgtctcctcctaatacgtttgataatcttatggcggagaaggaagctgtatcttcaaaatgtgtcaatttggctaaagagaatcaagtttttcaacaggagttatctatgaaaaaagcacaacaggaatgtgaaaaatttgaggaggataaaagatgttggaagaagaaatattaaatcttaagacacatatggaaaacagtatggtagaacttagtaaactacaagaatataaatcagagctagatgaaagggcaatgcaggcagtagaaaaattagacgaaatacatttacagatcgaataagaaaatagcaatgatcagtatcagctctttatggagaaagagcaggtgaaatattttctcagcactcttcctgcaaggcgaggtcgagagtcaccttgtgttgaaaatcttactagtataggactcaacgaaaatatattccccaaatgcccgtaagaattcctacttcaagcctcagacttcaaataattgccagaactacttgactgaggatgttccagcataagaagatatattctactcaagtccttgttccaccttttcaaatctcactggtctatttcccagtgggtttctaaaccaaacaccaataaactcagaaaatacagtgtaaaacaaagtgaagaacaaataaacaactcaccagagatttattcgtttcctgttgctcttggaaacacccagaggacactggaaacatagctgggatagaaggcaaatgacgtgggttaaggagagaactggtgtggtgtggtcccagattcttctgcccaacactctagacacattacttgggaaagccctcctccctcctgaaaaagaaaaacttccccatgggagaagggtccttcatgccccattaggggcaacaaagactcaagttaagataagatacatctacaagtacattaattggtagacattagatgcacaatttatttttgaataaaaacatgtattacctactaatttagtaacaa

SEQ ID NO: 289265 - DNA, 549 bp, Homo sapiens
cttatgaagaggttacaactgagttagaagaatataaggaagcctttgcagcagcattgaaagctaacagttccatgttaaaaaaattaactaaatcgaataagaaaatagcaatgatcagtatcagctctttatggagaaagagcaggtgaaatattttctcagcactcttcctgcaaggcgaggtcgagagtcaccttgtgttgaaaatcttactagtataggactcaacgaaaatatattccccaaatgcccgtaagaattcctacttcaagcctcagacttcaaataattgccagaactacttgactgaggttagttatatgaccgtttctctttagggtttcatttctctagcgtaattcttgtttataatttggtgaaatactgagttgttctgttgacttttgcatgtgaagtaaagatcataattagctgtgttaacacagaaaggaaatgggaactttacattttttaattccctggagctctcattttcaagagatatccatttgctaactttattcaataaatgtgactaaactgaga

SEQ ID NO: 289266 - DNA, 475 bp, Homo sapiens
aaaaatggagattctccagggacccttccgtatctgcctaggcattttgctgtctcctcctaatacgctgttgctgtactggacacttgctcccatctactctcttctctggaatccacgggggattcctaaggatgtcaccacagtgttggccagatgcacaggtcacaggggactgaatctcatcaccccacaaacataccattcaggttttgccaagaatgacactgtaaatgtaacaaagcttccgtgcttgttagtgaacaccaactcagctcctctcctgtattcagaaatcaggatgagatgaaaacaacaagcaggccaggtacggtggctcacgcctgtaatcccagcactttgggaggatgaggcaggtggatcacctgaggtcgggagtttgagaccaccctgatcaaaacagagaaaccccatctctactgaaaatacaaaattagccaggcatggtggcaaa

SEQ ID NO: 289267 - DNA, 1128 bp, Homo sapiens
agacaacttcaacaagaagcggctgacagcctaaaaaaattaactacgttagagtctccactggaaggtataaatgacaataaataagtgaaatgtatttggaaatgaagactttggttgccatggagacttaaaaacagatcaactgaaaatggatattctgattaagtttgataatcttatggcggagaaggaagctgtatcttcaaaatgtgtcaatttggctaaagagaatcaagtttttcaacaggacacaacaggaatgtgaaaaatttgaggaggataaaagatgttggaagaagaaatattaaatcttaagacacatatggaaaacagtatggtagaacttagtaaactacaagaatataaatcagagctagatgaaagggcaatgcaggcagtagaaaaattagacgaaatacatttacagatcgaataagaaaatagcaatgatcagtatcagctctttatggagaaagagcaggtgaaatattttctcagcactcttcctgcaaggcgaggtcgagagtcaccttgtgttgaaaatcttactagtataggactcaacgaaaatatattccccaaatgcccgtaagaattcctacttcaagcctcagacttcaaataattgccagaactacttgactgaggatgttccagcataagaagatatattctactcaagtccttgttccaccttttcaaatctcactggtctatttcccagtgggtttctaaaccaagtaagtacatttgcaatggtaatagtgacaccagtgactgaagttttggccaatctctcaaaattgagaaaataaccaaagggaaggcattgttaaagtgaactaagtatggcctgagaaggactccataattctatatatgagtccttgtggatgaactgcaacctaccttaataggtatacaagaatgaaaaactaacttgagagtatgcacctggaacaacagctacatcttggccaatcccagtggccaaacttcaaccactcaggcactgccaaatgttcaaaatgtgttcaaagaaggcaaacgctgagttgtttctgtacctcacttctgatttcggtatgccatttcccttttgtctataaatcttcttccaccaca

SEQ ID NO: 289268 - DNA, 585 bp, Homo sapiens
gccggtccgcgagcgcgtgtggtgtctgccttgtgagcactgcgggttcgctggaccccgcggccagggccgcgccccgcaccgcagctgtcggattacccaccgttcggttttccgctgtggctgaacacagcggctctgcccttgccagtctccatctcacctcggggatcggcaaatgcacacatcatggattctccggatgctccaacccgcggactccaatgggcgccccaagacgcccccagacccagcgcggcgccccaagcacatgggaccctctcaaggcaactcgccgcgcagtcagcggccgactagcagacccagagcagcgaggtcacggtgtccgcggcctcagcaggaaggaccccgcgatggttcttcacaattcacccccgcgaacaacgcacccgagcctgcgcgcacggagggctgccgcgcgtggaactgagcgggtcctgggttggtttgcggccctcttccctccgcccactcacatccctgccgggtgcgtccgcgctcacctgtcagtgcggcgggtcctcggggcctgcgctttcgacgcgtggcgctgagtgcggccgc

SEQ ID NO: 289269 - DNA, 347 bp, Homo sapiens
ctccttctccaaaaggttggtacttcactgatagacctttagttttaggatttgtactgacgtaaataatgctgggaccttttaagggccatagctcctgtaactggcagtagttaaatcctcttccttgtgaatttctattaatgaagttactttttcccttcttaggcaactaaagcagaggcagtggcccctacgtaaacccaaaaccaatcctaagaataagagatcaacaaatatttggagaaattacagctatggaaagatctgtgtcacaagcttgatgtttgaacaaattaggatcctactctaaacttgaatatatcagagttaaagttttagggatt

SEQ ID NO: 289270 - DNA, 401 bp, Homo sapiens
cgatcactgtccacgtgttaacaaaaaccagagccgccaccaccccatcactggccttgcggggcaggagtgactgtccccaggttgtcctgcagatgaagaagccaattcagagcaggtgaatgatctgcccaggggcgcacagccagtcagcggcagggcccagaggacatccaggtgcactcagctcccaagccaatggtgtttatgacacccttcttcccccaactaaagtccgcaagtggccaagcgcggtggttcacgcctgtaatcccagcactttgggaggccaaggcaggcagatcacctgaggtcaggagttcgagacctggccaacatgacaaagcgagacaccatctctacaacaaatacaaaaattagccaggcgtggtggcatgcac

SEQ ID NO: 289271 - DNA, 2448 bp, Homo sapiens
  misc_feature (257)..(257): n is a, c, g, or t
  misc_feature (307)..(307): n is a, c, g, or t
  misc_feature (322)..(322): n is a, c, g, or t
  misc_feature (330)..(330): n is a, c, g, or t
  misc_feature (2448)..(2448): n is a, c, g, or t
tgagcagtagcaagatttattgcaaagaatgaaagaacaaagctgccacagtgtggaaagggacctgagggggttgccaatgctggctcgggcagcctgcttttattctcttatctgacccaacccacatcctgctgattggtagagccgaggggtgtgttttgacagagcactgattggtgcgtttacaatccctgagctagatacaaaagttctccatgtccccatcagattagttagatacagagtatggacanaaaggttctccaaggccccaccagagcagctagatacagagtgtcattgntgcactcacaaaccntgagctanacacagggtgctgattggtgtgtgtacaaaccttgagttagatacagagtgccgattggtgtatttacaatccctgagctatatataaaggttctccatgtccccaccagactcaggagactagctggcttcacccatggatcgcgcactggggctgcaggtggagctgcctaccagtcccacgccatgcgcttgcactcctcagaccttgggtggtcgatgagactgggcgccgtggagtagggggcggcgctcctgagggaggctcgggccgcacaggagcccacggagggggtggggggctcaggcatggagggctgcagttacggacccctgccccgcggaaaggcagctaaggcccggcgagaaattgagcacagcgccggtgggctggtactgctggaggacccagtacaccctccgcagccactggcccgggtgctaagcccctcattgcacgcggctggcagggccggcaggctgctctgagggcagggcccgccaagcccacgcccacctggaactccagctggcccgcaagcgccgcgcgcagcccgggttcccactcgcgcctctccctccatacctccctgcaagctgagggagccggctacggccttggccagcccagaaaggggctcccacagtgcagtggtgggccgaagggcttctcaagtgccgccaaagtgggagcccaggcagaggaggcacggagagcgagcgagggctgtgaggactgccagcacgctgtcacctctcacagggaaacaccctgcaactttgcaagagcacggagagtgtggggcagggctaccccgcaggcctttggtctggcaccctcccttcctggtcctctgtctggtgttggcgggcaccttcgcagctgtggtggtcttggcggcgggtggaggcaggccaagacagcctgctctgaccagggacaggcacagaaaaagtggggaggggattgccggcggggtgttgtggtgtgaggcagctacttgctcagggttcctgagctgtgggaggccctcatgtgctgggtgctggacaggctctgctgctgtccgtgtgtgcggtgtcctcttctcttggtctcactgaggggtgggcgtgtccacccgagggaaccgctgtgaatagaagtagctgcagggctgtgcctgactctctccatgagactctagtggtttcatgggaggttgtatatgctcatggcctaaacatccttggatgcagcactggcagagggaagaaatcgtgtctgaggagctggtgcctgccttgcagaggacagcagccccgtgcacggtgaacccgagtattgagcaccttgtgtttctaggataagcctgctggacacaggtaccgggagcaggggtatttccatggctggcctgggcgcgcagattccccttcctccagggattttcccagtgaaatgtgtccttcaactttctgctgtttatgaagggtcctttgaggtgctattctcccttgtgagtgctgtgcttggctttctgtccctataacgtgccctcagggtgcccgcaattaagctgcccttctatctgcatgaatctgtccttggttcccctcgttgtcccccatgtcctgaatcctggctgagccccggtgcctaccaccttgtttcccccaaccccgctcctgggagctcggcgcccacccacctgtcagccatcccgaattggcagctgcaaggatatggctctgacccagaagccgtggatgccctgcggcctgggacattcactggagcccagctccaagtgaaggacgtccagcgagttggttgctggccggggcgtcctggggccagggccaggctgtgcctgcgggtcctcctgctgccgctccacattggcctcctccttggccaccacctctatctctgccatgatgtcatcccccactagccactagcatgcctcctcccccagggttgcctccctgctctgcgcacaggctgccctttcctgcagcacctcccccttaacatggtgccctccttgaggctcccacagactaaggcctacactgcccatctcatgtccttggcacccctagactctagaggaagctcccggaagggccccn

SEQ ID NO: 289272 - DNA, 1217 bp, Homo sapiens
ttcagggaactcaaaataggtgtgtggcctctagtcaccaaatggcttcttggctctgctttaaatttaggcccactcagccacttaagatccatcttgaaggactggctctttcagggtcacatttgttcatgcaaactattgatattgcatgctatttaccactatttcagatgaaattgccacaggatataaatcattggactatttaagagagcaaaggcttttggaagctgccacagtttcattcccaggtcctccacttaccagcaatgagacttcatgtgacctcaggtgctcctgctcaccttcatatttttttaagtatacatctgtgtatcatgaacaattcttatctcaaaatttaaaaatgaagtacacattataacagcattacaatcatgaacacatgtgctatgttctctgggagacaaagagaaactatttaccctactttccagaaaaggacactgacacttagagggaacacaagtgttgaaaccaggtctgaaatccaagacccaagatgcttttttgctgctaaagcattcattatccagactctgcctgcatgaaggtgatgcataggaaatgatgaacctggtaaaagcttccagtcttaaaaatactccaagtaaggctctttaaggcttctggtagggacattttattttttggtaaagccacaatagatagaaatgccataaaaacaaacatgtaaacaaggtatcagaactttggttcactgaaacatctcacacctaaaacacctgaggtacaaaggcaccttgctaggcgctagacagctaactctgctgcagccactttgatcctagccttggggccagggatggcacaggctgaatggaagggctgggacttcagtcacacaggagtcgccctagtatggtctccctctgctccagacaaacattcatttctccaaaaatcagcctgataggaacatacaaaggaacatacaaaggtgtctgtcacgttgacatgggctgaaggaccaggaaggggaaggacagaaaaggatgtcagtcaacttctgttgatccacaaggtctcaagaactcctgtcctcgttcatggaaccacttattggagacccacttgcagcccacaagcacagggcaggcagcatgtcttgttcggtagtcaccttccccgctccgcaagaggttgtaccagaacacagctgtaccctggga

SEQ ID NO: 289273 - DNA, 201 bp, Homo sapiens
ctcggcttcccaaaatgttgggattacaggtgggagccaccatgcccggcctgtaaccctaattattaaataatttgctgtggaatggattctaatattcaataatagaagttgtaattctgaacccttggaaatggaggaaggctagaggatatgataaaggagtccaaggagcatggcggacaccgacctgttcatgga

SEQ ID NO: 289274 - DNA, 384 bp, Homo sapiens
atttgtcacggtaagaaaaatctgtgagccttcttaacactgagcgtaaagaactcttgagagactcttaggacagaaaaccttaaagagggcaggtctttcacagttgctctgatgactgcatactttcgggatcatagtaagccagtcatgatctagtgtgatctgatgtgacagcagttgagatttataccaagatccatgtctttgtctgacctatgataaactttgtatggagatacatagtttcctttttccagaaggattggtaaggctgacattgggttgttgcatgattttggaggggaaacattaagctctggtcatagcttttcaccccaaggtcgacttggaattaatgaaaactttgctatcatgaccaag

SEQ ID NO: 289275 - DNA, 592 bp, Homo sapiens
cacaatttactgtccaatcttctttctttatgcagttgaacatatccagtttggaaatattatgaataaagatatttcgaacacttatgtgcgtgtatcttgatgcacataagcgtacatttttgtgggggaatatacctaggagtggattcatgggtcatgcatatctttaacttcagcagataagcagaaagcatttgacaaagtggttgagaaggtaatgagaattcctgttgctccacgttctaataaaaaacacttggattttctttcttttttttcaaatgacagggctctataatgggatcattgcatttctctgattactaatgagagtgagtactccttcatatgtttagtagatatttgaattgtatttgtttttgttgttgttgtagctcttcatgaaaagtactttctaaacagcatttttgagcaccctttagggagccaaaggccaaataagttagagtatttgtcacaacatggcaataagagaggcgaattcatccattaattgcttgccatatgcttatcactggaatatattttgcagcatctcctgacatcactatttatcccttttaccaaa

SEQ ID NO: 289276 - DNA, 6673 bp, Homo sapiens
  misc_feature (46)..(47): n is a, c, g, or t
  misc_feature (81)..(81): n is a, c, g, or t
  misc_feature (109)..(109): n is a, c, g, or t
  misc_feature (4106)..(4106): n is a, c, g, or t
  misc_feature (4320)..(4320): n is a, c, g, or t
gaattccctggatacagcctttttatgacttttacttcctttatanncaaattccaacgtcttctcattcctccaccaggnctgtgccaacctgggcccaacccaaggncctcactaaaccatccaatcagtaggagccatagactactttatttagccaaagcaaaaatgagtcaactgaattctgtttttccatttacttctgtctgtttttccttcctcttgccaccctcagtgccacaagaggggacccctctcggtagccctgaggctctggcgccttcaagtgagaagctaagcaccagcctctgctgggctgcagaagcggcggcggcggcagcagcagcagcagcatcaggaaggctctcgggccagcgcggtgaacccgggctgggcagcaggtcgcggagccgcgagccaggatggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289277 - DNA, 5972 bp, Homo sapiens
  misc_feature (2)..(2): n is a, c, g, or t
  misc_feature (3405)..(3405): n is a, c, g, or t
  misc_feature (3619)..(3619): n is a, c, g, or t
gnattcaatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289278 - DNA, 6187 bp, Homo sapiens
  misc_feature (3620)..(3620): n is a, c, g, or t
  misc_feature (3834)..(3834): n is a, c, g, or t
ggaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289279 - DNA, 6455 bp, Homo sapiens
  misc_feature (3888)..(3888): n is a, c, g, or t
  misc_feature (4102)..(4102): n is a, c, g, or t
ttgtttgtgaaacttcgcaggaagcagccggtcgtggagtcgcagaggctccagcggtctgggcaacctggagggcagtggctcggcggggcgcgcggggttctagcgagacaggtgcgcggccgtgcgcgcctgcgtgccggtccctcctgagccccgcggcgggcgcgaccccggacggcggactgcaggcgctccacgccgggttttccgccgctctcctagcacagacagtcccacagcagccccacagacacacacgctcgcgcccgcgcctcctcgtctgcacttcaaagcgagtggcgcccggctgcgccggggggatggcactgcgaggtggcggggcccccggggcagagctcgaggggaaggacgcggcgggtggcacggacagggacaggcttttgcaattcggaatcttttcgtaagggggttgaggaggagccaggcagcgccgagggccgagaggggcgtgagggggagtgttcccggaaagctgcggcgttggagccgcgctgcgcctgccgcccgaggagttgagaaagaaaacaggaaacgtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcgggaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289280 - DNA, 6541 bp, Homo sapiens
  misc_feature (3974)..(3974): n is a, c, g, or t
  misc_feature (4188)..(4188): n is a, c, g, or t
ttgtttgtgaaacttcgcaggaagcagccggtcgtggagtcgcagaggctccagcggtctgggcaacctggagggcagtggctcggcggggcgcgcggggttctagcgagacaggtgcgcggccgtgcgcgcctgcgtgccggtccctcctgagccccgcggcgggcgcgaccccggacggcggactgcaggcgctccacgccgggttttccgccgctctcctagcacagacagtcccacagcagccccacagacacacacgctcgcgcccgcgcctcctcgtctgcacttcaaagcgagtggcgcccggctgcgccggggggatggcactgcgaggtggcggggcccccggggcagagctcgaggggaaggacgcggcgggtggcacggacagggacaggcttttgcaattcggaatcttttcgtaagggggttgaggaggagccaggcagcgccgagggccgagaggggcgtgagggggagtgttcccggaaagctgcggcgttggagccgcgctgcgcctgccgcccgaggagttgagaaagaaaacaggaaacgtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcggggtatggcaggatggccccctttgaactcgctagcggacccgtgaagcgcttgagaactgagtccccctttccctgtctcttcgcagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289281 - DNA, 6231 bp, Homo sapiens
  misc_feature (3664)..(3664): n is a, c, g, or t
  misc_feature (3878)..(3878): n is a, c, g, or t
ggaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagggctctataatgggatcattgcatttctctgattactaatgagaaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289282 - DNA, 5619 bp, Homo sapiens
  misc_feature (2)..(2): n is a, c, g, or t
  misc_feature (3052)..(3052): n is a, c, g, or t
  misc_feature (3266)..(3266): n is a, c, g, or t
gnattcaatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatgaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289283 - DNA, 1027 bp, Homo sapiens
ggaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaag

SEQ ID NO: 289284 - DNA, 845 bp, Homo sapiens
tagatggtcaagggttctctcactgaagtcactgcattgctggttccttccacagcaccccttactaatatctacagtaagaggccaaaagtaaaactcaggccccactgctggaacaccatttctactattgcatatcctgtgtgcctaaaaagcaacagtgaccctggctgatgatcaagaagcccctctttttacccagggagttggacaattgttaacatcccagaagacatatttttaacccagttgctgggaagaacatgtgctgaagtataaggatggaatcactgtaattctctatgggaactcatgaaagtggaacttgccgtttaatattgaacgacactgagcacagagttattgatgatttctaatgcgggatttggtttatttttcagacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaag

SEQ ID NO: 289285 - DNA, 6014 bp, Homo sapiens
  misc_feature (3447)..(3447): n is a, c, g, or t
  misc_feature (3661)..(3661): n is a, c, g, or t
actgcacaaaggaaatgccctcactcagctacaagtgcctcctgctccgtgcggggcctcagggccccagagccccgcaccagctctgacttctcgtggttcctggggatcttggcatcgtccttaaaaatggcttttgtttgggatcctctgggagccacggtgccaggaccatctacaagagccaaatcaagattgcgtttctcaaagtcctacagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289286 - DNA, 6560 bp, Homo sapiens
  misc_feature (46)..(47): n is a, c, g, or t
  misc_feature (81)..(81): n is a, c, g, or t
  misc_feature (109)..(109): n is a, c, g, or t
  misc_feature (3993)..(3993): n is a, c, g, or t
  misc_feature (4207)..(4207): n is a, c, g, or t
gaattccctggatacagcctttttatgacttttacttcctttatanncaaattccaacgtcttctcattcctccaccaggnctgtgccaacctgggcccaacccaaggncctcactaaaccatccaatcagtaggagccatagactactttatttagccaaagcaaaaatgagtcaactgaattctgtttttccatttacttctgtctgtttttccttcctcttgccaccctcagtgccacaagaggggacccctctcggtagccctgaggctctggcgccttcaagtgagaagctaagcaccagcctctgctgggctgcagaagcggcggcggcggcagcagcagcagcagcatcaggaaggctctcgggccagcgcggtgaacccgggctgggcagcaggtcgcggagccgcgagccaggatggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgttcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagnaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacanccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctactcttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatcggcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtataaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttggcatttgattatttcctttttttttttttttaactcggaaacacaactgggggaaatatattctttcccagtgattataaacaatctttttcttt

SEQ ID NO: 289287 - DNA, 1412 bp, Homo sapiens
aagctggtacggtcccgaattatggaatccagctgggcggggcttcgccgtgttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataagatattcactgagcacctaatattgccaggctgtgctcaaggcagtgggattcatcagtgaacaatacagacaaaaatcactgacctaaatggagcttgaagtttatatctaaatcattcaaagattctgtggtggaaaagaagttagaaatctttcagctgcaaaacataagccaaaatacaactcacctttggaatcagagaacttacaggttcataaaattgcgaagcccagatgtgcacctgaggtgagacttcgtccagcttctgtctgtgtcactaatctttcctgctttcagcggcatccctcgcaggcccgtgttgttcccaactggtgttcccacctggcggcaaactggtgactgtagttacagatcttcaacatcacactcaggagaagaaggagattgcttttcaggagctcctgcaagccggagaataaaagctcttatttattcagaagccctaaaacataccaccttggctgtagacatatttggacatttctaagcaaatctgtctgcaaaggtgctgagctgtgttgatcaactgaagcccgtgacgtctcatccttgcagttggagcaaatctcaaaggcaaagccagtgttaaggagagggaaatcagacttcatctttcgatgggagaagaaaagagtttgcaactgtctctattctgccactggcagagaatccataggtttgctaaggatacagagccacattgaaaagataaaccttgctatgctggagattacttaggtgggccaggatttcttgaaaccaaaactttactgaatcacctcttcaccatctgtatgccgtgcatttgctgagagataaaaacattcctgtgaaagatgcccttccctgcaccgggagaaaagaagcattctgcgaccaggagccatagcgaagataattctgtagaaacagaccgtggtaaaataatgcctatcttcctgcagcctccccacgtaatttagttacttttccacagctgcttctttttgctcaacctaatatcaaagcagttaggtattgccatttctttgggtcttcattttcttattcaggctcctgtgccatgtaaaacctctattaaatttgtatgattttctcctgataacctacctatgtcaacttcactctcagatccagcctgggcgacagaacgagactgtgtcttaaaaacaaaaacaaaaacaaa

SEQ ID NO: 289288 - DNA, 1937 bp, Homo sapiens
aagctggtacggtcccgaattatggaatccagctgggcggggcttcgccgtgttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataagaagtgggtgccgaggctcccttcccactgccattccactggcccagaggaagcttctgttgtgttcagatgggcaggcactcttcctcgagaagttaagtagccggaatatctaaatgcctctccttggcgattactcgatgagcgcctgtccttcctccactcttccagcagacctgccttttggggctgatggaaatatgcatattagattatctgcagaaactggctcagcactacaaggaggctgccaacatgaagacactggatgcggaatcaggaggagatgtatacagctcagtctccaaagccaggacaagccagctccaacacactactggctgaatctcaccaatcgttatagttttgttttttgtttttttaaatgtatttaagcatttttaggtgttttaaattttatgtgtgtattctaggaatatgtactcagattctttcattaggcatgtgttattaacaacattcatcttcttaaaggctgaaccaactttgcgcgttttatcaacagatattcactgagcacctaatattgccaggctgtgctcaaggcagtgggattcatcagtgaacaatacagacaaaaatcactgacctaaatggagcttgaagtttatatctaaatcattcaaagattctgtggtggaaaagaagttagaaatctttcagctgcaaaacataagccaaaatacaactcacctttggaatcagagaacttacaggttcataaaattgcgaagcccagatgtgcacctgaggtgagacttcgtccagcttctgtctgtgtcactaatctttcctgctttcagcggcatccctcgcaggcccgtgttgttcccaactggtgttcccacctggcggcaaactggtgactgtagttacagatcttcaacatcacactcaggagaagaaggagattgcttttcaggagctcctgcaagccggagaataaaagctcttatttattcagaagccctaaaacataccaccttggctgtagacatatttggacatttctaagcaaatctgtctgcaaaggtgctgagctgtgttgatcaactgaagcccgtgacgtctcatccttgcagttggagcaaatctcaaaggcaaagccagtgttaaggagagggaaatcagacttcatctttcgatgggagaagaaaagagtttgcaactgtctctattctgccactggcagagaatccataggtttgctaaggatacagagccacattgaaaagataaaccttgctatgctggagattacttaggtgggccaggatttcttgaaaccaaaactttactgaatcacctcttcaccatctgtatgccgtgcatttgctgagagataaaaacattcctgtgaaagatgcccttccctgcaccgggagaaaagaagcattctgcgaccaggagccatagcgaagataattctgtagaaacagaccgtggtaaaataatgcctatcttcctgcagcctccccacgtaatttagttacttttccacagctgcttctttttgctcaacctaatatcaaagcagttaggtattgccatttctttgggtcttcattttcttattcaggctcctgtgccatgtaaaacctctattaaatttgtatgattttctcctgataacctacctatgtcaacttcactctcagatccagcctgggcgacagaacgagactgtgtcttaaaaacaaaaacaaaaacaaa

SEQ ID NO: 289289 - DNA, 1692 bp, Homo sapiens
aagctggtacggtcccgaattatggaatccagctgggcggggcttcgccgtgttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataaggctgccaacatgaagacactggatgcggaatcaggaggagatgtatacagctcagtctccaaagccaggacaagccagctccaacacactactggctgaatctcaccaatcgttatagttttgttttttgtttttttaaatgtatttaagcatttttaggtgttttaaattttatgtgtgtattctaggaatatgtactcagattctttcattaggcatgtgttattaacaacattcatcttcttaaaggctgaaccaactttgcgcgttttatcaacagatattcactgagcacctaatattgccaggctgtgctcaaggcagtgggattcatcagtgaacaatacagacaaaaatcactgacctaaatggagcttgaagtttatatctaaatcattcaaagattctgtggtggaaaagaagttagaaatctttcagctgcaaaacataagccaaaatacaactcacctttggaatcagagaacttacaggttcataaaattgcgaagcccagatgtgcacctgaggtgagacttcgtccagcttctgtctgtgtcactaatctttcctgctttcagcggcatccctcgcaggcccgtgttgttcccaactggtgttcccacctggcggcaaactggtgactgtagttacagatcttcaacatcacactcaggagaagaaggagattgcttttcaggagctcctgcaagccggagaataaaagctcttatttattcagaagccctaaaacataccaccttggctgtagacatatttggacatttctaagcaaatctgtctgcaaaggtgctgagctgtgttgatcaactgaagcccgtgacgtctcatccttgcagttggagcaaatctcaaaggcaaagccagtgttaaggagagggaaatcagacttcatctttcgatgggagaagaaaagagtttgcaactgtctctattctgccactggcagagaatccataggtttgctaaggatacagagccacattgaaaagataaaccttgctatgctggagattacttaggtgggccaggatttcttgaaaccaaaactttactgaatcacctcttcaccatctgtatgccgtgcatttgctgagagataaaaacattcctgtgaaagatgcccttccctgcaccgggagaaaagaagcattctgcgaccaggagccatagcgaagataattctgtagaaacagaccgtggtaaaataatgcctatcttcctgcagcctccccacgtaatttagttacttttccacagctgcttctttttgctcaacctaatatcaaagcagttaggtattgccatttctttgggtcttcattttcttattcaggctcctgtgccatgtaaaacctctattaaatttgtatgattttctcctgataacctacctatgtcaacttcactctcagatccagcctgggcgacagaacgagactgtgtcttaaaaacaaaaacaaaaacaaa

SEQ ID NO: 289290 - DNA, 1790 bp, Homo sapiens
aagctggtacggtcccgaattatggaatccagctgggcggggcttcgccgtgttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataagaagtgggtgccgaggctcccttcccactgccattccactggcccagaggaagcttctgttgtgttcagatgggcaggcactcttcctcgagaagttaagtagccggaatatctaaatgcctctccttggcgattactcgatgagcgcctgtccttcctccactcttccagcagacctgccttttggggctgatggaaatatgcatattagattatctgcagaaactggctcagcactacaaggaggctgccaacatgaagacactggatgcggaatcaggaggagatgtatacagctcagtctccaaagccaggacaagccagctccaacacactactggctgaatctcaccaatcgttatagttttgttttttgtttttttaaatgtatttaagcatttttaggtgttttaaattttatgtgtgtattctaggaatatgtactcagattctttcattaggcatgtgttattaacaacattcatcttcttaaaggctgaaccaactttgcgcgttttatcaacagatattcactgagcacctaatattgccaggctgtgctcaaggcagtgggattcatcagtgaacaatacagacaaaaatcactgacctaaatggagcttgaagtttatatctaaatcattcaaagattctgtggtggaaaagaagttagaaatctttcagctgcaaaacataagccaaaatacaactcacctttggaatcagagaacttacaggttcataaaattgcgaagcccagatgtgcacctgaggtgagacttcgtccagcttctgtctgtgtcactaatctttcctgctttcagcggcatccctcgcaggcccgtgttgttcccaactggtgttcccacctggcggcaaactggtgactgtagttacagatcttcaacatcacactcaggagaagaaggagattgcttttcaggagctcctgcaagccggagaataaaagctcttatttattcagaagccctaaaacataccaccttggctgtagacatatttggacatttctaagcaaatctgtctgcaaaggtgctgagctgtgttgatcaactgaagcccgtgacgtctcatccttgcagttggagataaaccttgctatgctggagattacttaggtgggccaggatttcttgaaaccaaaactttactgaatcacctcttcaccatctgtatgccgtgcatttgctgagagataaaaacattcctgtgaaagatgcccttccctgcaccgggagaaaagaagcattctgcgaccaggagccatagcgaagataattctgtagaaacagaccgtggtaaaataatgcctatcttcctgcagcctccccacgtaatttagttacttttccacagctgcttctttttgctcaacctaatatcaaagcagttaggtattgccatttctttgggtcttcattttcttattcaggctcctgtgccatgtaaaacctctattaaatttgtatgattttctcctgataacctacctatgtcaacttcactctcagatccagcctgggcgacagaacgagactgtgtcttaaaaacaaaaacaaaaacaaa

SEQ ID NO: 289291 - DNA, 568 bp, Homo sapiens
cctgggccgacttcggtactacagaattatcttcgctatggctctggtcgcagaatgcttcttttctcccggtgccagaatgtgcaccccaaaatatgtcactttggcataaggattattttgagttagaaacacttgaaaaacagcagatagaagaagtgcatgtcattctccccttttctcctcaaaaacaggagataaaaacattcctgtgaaagatgcccttccctgcaccgggagaaaagaagcattctgcgaccaggagccatagcgaagataattctgtagaaacagaccgtggtaaaataatgcctatcttcctgcagcctccccacgtaatttagttacttttccacagctgcttctttttgctcaacctaatatcaaagcagttaggtattgccatttctttgggtcttcattttcttattcaggctcctgtgccatgtaaaacctctattaaatttgtatgattttctcctgataacctacctatgtcaacttcactctcagatccagcctgggcgacagaacgagactgtgtcttaaaaacaaaaacaaaaacaaa

SEQ ID NO: 289292 - DNA, 977 bp, Homo sapiens
aagctggtacggtcccgaattatggaatccagctgggcggggcttcgccgtgttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataagactctcatgctaacagctattggatggaaagagatgtttgggcttctgtggttgtttactgtgtacgccagatagaaccgtgggtctccagctgctgttccacacagatgtttggctaactccagctaggctgaaatattggcagattcattttactgaaggatttcagtttccgtgacttcttggtgggacctgaatgctctgaaaagctttgagcattttcacctcaaccttgggtgtgaacagtcttgtattttcttgcctttggaaagtagttcttagtgactggaagcctgaggcttgggtgatattgtcaggaaccaggatgaacctgaggggcctggacaccgctgaaatgtgtttgattctagtccttaatcatttcccaaccagcctggctaaacaattgtgtgggccactataaccatcggtacttcttctctttctgctttttcatgactctgggctgtgtctactgcagtatggaagttgggacctttccgggagggctatgctggccatgagaacattgaaccagctcgacaagaacaaactacggggtgccaaccagaatatcaacagacccacaacccacttccttcgacaaggtgactcccagatctgctacccggtccgggcatctggcactccggggccaacggtggatggctcaaggaggaatgctaggcactcacaggagctgcagcaggagtaatcaccggcgacgagcccggcacagctcgccacccagaagccccgccggggcccccgtg

SEQ ID NO: 289293 - DNA, 547 bp, Homo sapiens
aagctggtacggtcccgaattatggaatccagctgggcggggcttcgccgtgttaccttctcaacatggcgagcttgctggacgtcacgtcgccttcgccttttccgctgcggactctgctcaccgacctcctcagtagagccggccctgctcactaccgcgcccacgtgtcctgttgtgcttcattcccacaggccgcataagcaattctacatctggactttatcctacaaatgttcctgcgtgtgtatgaaagagggaaagattgaaaacaacccaagtgtccgtccacggggactctggttaaatgaagtgtggaatccctgcagtgaacaccagccttccataatggacagaggcagcccttctctacgcatcagaaataacccaagatagaggaagctctctcggtacccatcagaaatatccccagacagagagagccctctgcgtgtcaatcagaagtgtgcccagacagaacttttcatctttcatcgaacaaatctatttatggtggcttcttttaccagttcttctgcctgatccc

SEQ ID NO: 289294 - DNA, 5533 bp, Homo sapiens
  misc_feature (31)..(31): n is a, c, g, or t
  misc_feature (69)..(69): n is a, c, g, or t
gtgaaggcacccatctggcagggggcagggngctcttgcaggttccgccgtgcagagaagaagccacanggaccgagggaggcctgaaggagatgtctaacctgagccgtagaacgtaagaagttgccagcataaagacaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagctcgtgccaagcggacctcgtgaaggacaacggccacaagtacttcctgtcggtcctggcggacccctacatgccagctgaacaccggaccatgacggctttcattctcgccgtgatcgtcaacagctatcacacggggcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgctgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 289295 - DNA, 6208 bp, Homo sapiens
  misc_feature (13)..(13): n is a, c, g, or t
  misc_feature (102)..(102): n is a, c, g, or t
tcagacttttgcntgagtaagggtctccgcactctttatccatttggttttcgatttcccgtttttgtttcttatttcaccaattctggtacacgctagttnttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggctttcatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagctcgtgccaagcggacctcgtgaaggacaacggccacaagtacttcctgtcggtcctggcggacccctacatgccagctgaacaccggaccatgacggctttcattctcgccgtgatcgtcaacagctatcacacggggcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgctgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 289296 - DNA, 3124 bp, Homo sapiens
cctgggcgacagagcgagactccatctcaaaaaaaataaataaataaataagggggaaaagatgctggctcctggatccactcttgtgtgtttcttttgacaggcattacgagattggacgaccaaatatttctgaacaggaaccccggcgtcccctctgtggtgaaattccaccccttcacgccgtgcatcgctgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 289297 - DNA, 6153 bp, Homo sapiens
  misc_feature (13)..(13): n is a, c, g, or t
  misc_feature (102)..(102): n is a, c, g, or t
tcagacttttgcntgagtaagggtctccgcactctttatccatttggttttcgatttcccgtttttgtttcttatttcaccaattctggtacacgctagttnttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggctttcatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagctcgtgccaagcggacctcgtgaaggacaacggccacaagtacttcctgtcggtcctggcggacccctacatgccagctgaacaccggaccatgacggctttcattctcgccgtgatcgtcaacagctatcacacggggcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgctgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctcctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 289298 - DNA, 1477 bp, Homo sapiens
cttggcacgaggtggcacgagtggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 289299 - DNA, 1444 bp, Homo sapiens
cacgagggggctgtgcgcttcctgctcagtgatgctgccagcggccaaggacagcccggacccctgggcggcttccttcacacccgccagttggaggggcgtctccttcttccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcaga

SEQ ID NO: 289300 - DNA, 2008 bp, Homo sapiens
  misc_feature (13)..(13): n is a, c, g, or t
  misc_feature (102)..(102): n is a, c, g, or t
tcagacttttgcntgagtaagggtctccgcactctttatccatttggttttcgatttcccgtttttgtttcttatttcaccaattctggtacacgctagttnttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggctttcatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggtgagtggcccctgctgtgcccctgggacccactcaactgggctctcccgcagggaccccaacccatgtgggccccaggcattcacctggtcccaggagcccacgtgacagacatgagtgtccccgccttctttttgtgtcattcgggattccaggtggaggtttgggttctactctttgagagctcaagatccttcttccttctgatctgttcgtgggcagctcactgctttgcgatttccaagaacaccctctccttacctttgttcactgcggaggcgtcttagtaccaggataggtcatactggaaactggactttctttcaggggaagaaaaggctgttatgaaaaaggaagtcatttaattccttgcttgagttgaagcgtaatctttcaatgtatttttagcaatgaaaaaagagccatgatttttctgtctccatcctttttaagttatagccgtcgggaacataactgaagaaatgtgtgtgatattccaagatggtagaagccgcatttcagccccaacatccccagcagaacgcacagtgggatatgtgtgtttcctgcctccaaatccaatattctcccctagaccatcttgccagtctttaatatctcctttcccattttatgttttgctgaaaagcttatatgtcgtggctgttaccggctagtagataaatacctctcccttgaggtgccgtgcgaatggtgcagctgtgcagcagacaccgtgctgtcggccgaggacactcttgaggcttctgtcaagatggcctaacactctagacaagtctcctgccttctcacccacagccctgggcggacacggggagctaacagcacagcaaagtaagggcccccagggacaccctgggaggggccagaggggcagggcagcctgaggggggaggaaaacttggccttcctgctctgcctctgcagccaagtccaaattgatcccagaccccagggctgggggttcatgatgttggggtgactgcagcgcagcc

SEQ ID NO: 289301 - DNA, 1695 bp, Homo sapiens
  misc_feature (13)..(13): n is a, c, g, or t
  misc_feature (102)..(102): n is a, c, g, or t
tcagacttttgcntgagtaagggtctccgcactctttatccatttggttttcgatttcccgtttttgtttcttatttcaccaattctggtacacgctagttnttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggctttcatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggtgagtgtttcaggatcctccaggtgccgtgctcccccgccctccgtggcactgtgatgtcatggaattgcacggagctgggcagggaggccccacacctaacttggggaccccgtgtagcattaacaagtgaagctaaatgcagggctcccagagatctccacacagaggagtgggggtctccttcagagggcagaagccttggagggccttttaggactgcacgggagcagcggccggctgaagcctcacagctctgcaactcgggagggtagcactttgcaagagagtttctaaccttttagaaaccagtagtgagaaaataacttgctgacttgaatttatgaagcacatgcaagatcgctctggagaattaaactgttgggctcatgatcaa

SEQ ID NO: 289302 - DNA, 882 bp, Homo sapiens
  misc_feature (13)..(13): n is a, c, g, or t
  misc_feature (102)..(102): n is a, c, g, or t
tcagacttttgcntgagtaagggtctccgcactctttatccatttggttttcgatttcccgtttttgtttcttatttcaccaattctggtacacgctagttnttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggctttcatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggagagctgcaatcaacccaaatcaccctcttgttgaagacccagacctccgtgactgtgggccgggcac

SEQ ID NO: 289303 - DNA, 596 bp, Homo sapiens
tggagcaggtcacctggagggggctctgaccctgcgtgagcactagcccctcgtggggagcggacgggcgagggcctgcggacccgctggcacaggcagacctgggcagctcccggtgagagccccgaagggtggggacgtccttcagggaagccccacgctgagcgtgccccctcccctacagccgcgtcatgacgtaccgggagcacacagcctgggtggtgaaggcctccctgcagaagcgtcccgacggccacatcgtgagtgtgaggtgaggagcgccgatatttagcagccgttctgctgtaaaaacattattttcccctccatttaaaatacgtccttggtatttaaacagctggaaggggatggcatttcgggcagtaattaactcctgccctggaactggccagaaagatcaggcgcagcccgtaggggcccaggggccacagctgctcccctgctgggggacacctgacctgcaggcgctttgggaactttcctgggctgccaactgcggagggttccggggggagttgggcagctgctctccctccacgggcaggggtggcagggtggcaggggcggcgcgtctg

SEQ ID NO: 289304 - DNA, 340 bp, Homo sapiens
tctggctaacacctcacttacagccttgggagagattctgagtcagaggcatccagctaaattgacccacagacacgttcaaattctggatgagaattcgcttctgcaaattagaagcaattcatctaagataatgaacacagaagcgaagcagaagccattttcctacatcctttcgactgttttaactgcaaacaaagataaagaaatgcaaggtgttagcagtgctttttgtggcactttccaattttctgggtgtcaagaggcaattgtgactacagcattagcagtgtaactctggcttcctgattactggattgcagcaagaggagtatattca

SEQ ID NO: 289305 - DNA, 1819 bp, Homo sapiens
gctaggactaagtgagcttctcccttcttgttgtagaggaaatccgaaaaactgcctggtttgccacctcaccctacctcccccacgagcgaaggagtgcgtgcggctttactcccagcccgactggtccactcccagaaaagcctcggtgggactccgacgtctagggagttgtagccgctaccagaaatatcgatgagcctttaccctgaggtttagaaaggcagctctttctggggcaaatacaaagagcgtgtttcttcctacaaattagtggcatcctcccgctgtatggattcagctggcaaagtaactcaagccttgtcctgactgcaagggtgggcggggtggacggctcggtgttctgcccgttgtgtcttacgctccaggtgctggtctacgcgggcctggacagtcaggggtaggagcgggagccgagaggaggcggaggagatggcgtcccagccgccacctccccccaaaccctgggagacccgccgaattccgggagccggaccgggaccaggaccgggccccactttccaatctgctgatttgggtcctactttaatgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagta

SEQ ID NO: 289306 - DNA, 1463 bp, Homo sapiens
gctaggactaagtgagcttctcccttcttgttgtagaggaaatccgaaaaactgcctggtttgccacctcaccctacctcccccacgagcgaaggagtgcgtgcggctttactcccagcccgactggtccactcccagaaaagcctcggtgggactccgacgtctagggagttgtagccgctaccagaaatatcgatgagcctttaccctgaggtttagaaaggcagctctttctggggcaaatacaaagagcgtgtttcttcctacaaattagtggcatcctcccgctgtatggattcagctggcaaagtaactcaagccttgtcctgactgcaagggtgggcggggtggacggctcggtgttctgcccgttgtgtcttacgctccaggtgctggtctacgcgggcctggacagtcaggggtaggagcgggagccgagaggaggcggaggagatggcgtcccagccgccacctccccccaaaccctgggagacccgccgaattccgggagccggaccgggaccaggaccgggccccactttccaaatggcttctctatctttaaagcgtagactttggtctgtagcagttgagagcggcatttgtccagccacggcatcgacagggagcaaagtctctccttaaaggtgttaacctctcgagaagttgctgaaagccggaaaggttttacgcaacaggaactcaagccccgtacactttgcattcttttccagcataactcagccagtgtttcggatcgagattggagaagcaactttaaagcaggagttctagatctgaggcctatggatggactttgtgtgcaaaatagtgtatttttctgaggcctgtattttttttttggtttggtttttaatcagtatcagttggtttctaggactttaaaaaggctaaaacatgcagagttgggagtgtttcgtggcctcgtgtggcttttgtttggtagtgctggacatcttaattcagataggtgtgattcaaatgtcaaatcacctactattgtaggttttcctaagcgtaaaaaccccaacatattggaatgtatttctgctgtattctgaaatcttttatttaaacactaaaatgctttaacacagtaacgacttagtttaataaggatatatacataacaagtaataagtttgattaggctggtaagccacggtgacattatctgctaccttttttttgagtgggttcttttttccccatttaggctgcttgtcgaatgagagaggttttattttttgcatctgttaaagttctttttatgtaaaattaaccattttcccactttatcgtgaaatattttaaacacagagaccagtagagagtaagataatacctatatattcactactcaactttaaacagtgttaacatttgccagacttatgtcgaatttttcaaaataaaagacggctaaactctcccattcttct

SEQ ID NO: 289307 - DNA, 1441 bp, Homo sapiens
gctaggactaagtgagcttctcccttcttgttgtagaggaaatccgaaaaactgcctggtttgccacctcaccctacctcccccacgagcgaaggagtgcgtgcggctttactcccagcccgactggtccactcccagaaaagcctcggtgggactccgacgtctagggagttgtagccgctaccagaaatatcgatgagcctttaccctgaggtttagaaaggcagctctttctggggcaaatacaaagagcgtgtttcttcctacaaattagtggcatcctcccgctgtatggattcagctggcaaagtaactcaagccttgtcctgactgcaagggtgggcggggtggacggctcggtgttctgcccgttgtgtcttacgctccaggtgctggtctacgcgggcctggacagtcaggggtaggagcgggagccgagaggaggcggaggagatggcgtcccagccgccacctccccccaaaccctgggagacccgccgaattccgggagccggaccgggaccaggaccgggccccactttccacgtagactttggtctgtagcagttgagagcggcatttgtccagccacggcatcgacagggagcaaagtctctccttaaaggtgttaacctctcgagaagttgctgaaagccggaaaggttttacgcaacaggaactcaagccccgtacactttgcattcttttccagcataactcagccagtgtttcggatcgagattggagaagcaactttaaagcaggagttctagatctgaggcctatggatggactttgtgtgcaaaatagtgtatttttctgaggcctgtattttttttttggtttggtttttaatcagtatcagttggtttctaggactttaaaaaggctaaaacatgcagagttgggagtgtttcgtggcctcgtgtggcttttgtttggtagtgctggacatcttaattcagataggtgtgattcaaatgtcaaatcacctactattgtaggttttcctaagcgtaaaaaccccaacatattggaatgtatttctgctgtattctgaaatcttttatttaaacactaaaatgctttaacacagtaacgacttagtttaataaggatatatacataacaagtaataagtttgattaggctggtaagccacggtgacattatctgctaccttttttttgagtgggttcttttttccccatttaggctgcttgtcgaatgagagaggttttattttttgcatctgttaaagttctttttatgtaaaattaaccattttcccactttatcgtgaaatattttaaacacagagaccagtagagagtaagataatacctatatattcactactcaactttaaacagtgttaacatttgccagacttatgtcgaatttttcaaaataaaagacggctaaactctcccattcttct

SEQ ID NO: 289308 - DNA, 514 bp, Homo sapiens
  misc_feature (20)..(20): n is a, c, g, or t
  misc_feature (52)..(52): n is a, c, g, or t
ccgggcgaggcgccgtctgngaggaattcccggctgtgatatgctgaacttngctctcaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagta

SEQ ID NO: 289309 - DNA, 1308 bp, Homo sapiens
gctaggactaagtgagcttctcccttcttgttgtagaggaaatccgaaaaactgcctggtttgccacctcaccctacctcccccacgagcgaaggagtgcgtgcggctttactcccagcccgactggtccactcccagaaaagcctcggtgggactccgacgtctagggagttgtagccgctaccagaaatatcgatgagcctttaccctgaggtttagaaaggcagctctttctggggcaaatacaaagagcgtgtttcttcctacaaattagtggcatcctcccgctgtatggattcagctggcaaagtaactcaagccttgtcctgactgcaagggtgggcggggtggacggctcggtgttctgcccgttgtgtcttacgctccaggtgctggtctacgcgggcctggacagtcaggggtaggagcgggagccgagaggaggcggaggagatggcgtcccagccgccacctccccccaaaccctgggagacccgccgaattccgggagccggaccgggaccaggaccgggccccactttccatatgaaaatgtgggaataggaacagctctggtctgcagctcccagcgtgattgacgcacaggacgggtgatttctgtgtttccaactgaggtacctggttcatctcactgggactggttgaacactggtcgcaccccatggagggtgagccaaatcgaggcggggcatcacctcacccaggaagcgcaagggattgggggatttccctttcctaaccaagggatgccgtgacagactatacctggaaaaatgggacacttctgcccaaatagtgggctttttccacagtcttagcaacaagcagaccaggagattctctcccatgcctggcttgacggatcctatacccatggagccttgctcagtgctagcacagcagtctgagatcaatctgcgaggcagcagcctggcagggggaggggaatccaccattgctgaggcttgagtaggtaaacagagcgcccaggaagcttgaactgggaggagcccactgcagctcagcaaggcctactgcctccatagacttcagctctgtgggcagggcatagctgagcaaaaggcagcagaaacttctgtggacttaaacgtccctgtctgatagctctgaagagagcagtggttctcccagcatggtgtttgagctctgagaacggacagacggcctcctcaagtgggtccctgacccccgtgtagcctgactgggaaacacctcccagtaggggctgaaagaaacctcaaacaggcaggtgtccctctgggacaa

SEQ ID NO: 289310 - DNA, 1079 bp, Homo sapiens
ttttaatttggcttatagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttacaaatctctttttaccaaaccactatactacgtaagctataaggtagcacacaggtttgcctgatttcatgttgagattgatacaagagaagcgttgcacagtgtatggaagtctgtgttgtgtgtgctgtgtataaggctgaactaaagggtttcactagcttggcagccgtgtatttgccaagttgcggagaagtagtcggatgaaagagcacaagtagtcctgttgtagtattcgtgttacactgttttggccatgcaagggttggaagcagagtagcgtgtgtatgaggtagcgtgtgttgtaagagagttagttgtgctcaggcagaaggagaagtgagagtgtgacaatagtgcgcaaggtgagagaagcagttgtggttagttgggcgtagtgttgcaaggtgttttgctgctagaaattattaaagttacacactagtatgttggtctggtgacctggttacattttattatacacattattggaccataaggacatttgtttcacctagattttaagattatggagactgctgtcatttttatcttatttaaatctctaggtttattggaagagtaagattgatgaactatagcatgcacagtttggtacagtagagatcattaatacttttaaaagttctacattaattgacttggaatccttagaaatggagtggtgacatgtcagtatgagaacaggcaaaaggtaaatttttttttttttttacaaccttaagtaatctcaataataaaattttctgatctgtattaaaac

SEQ ID NO: 289311 - DNA, 1087 bp, Homo sapiens
ctcatggcaacctctacctcctgggttcaagtgattctcctgcctcagtctcccggacagttgagactacaggcgcgtgccactccgcccagctaatttttgtatttttaatagagatggggtttcactatgttggccaggctggtcttgaactcctgacctcaggtgatctgcccacctaggcctcccaaagtgctgagattacaggtgtgagtcactatgcccagcccttaccttgctcagatttttattgtgaagaaatattaaattttatgaatggcttttctgcatctgttgagaccattgtatgtattttcgctttagtatgaaaatgtgggaataggaacagctctggtctgcagctcccagcgtgattgacgcacaggacgggtgatttctgtgtttccaactgaggtacctggttcatctcactgggactggttgaacactggtcgcaccccatggagggtgagccaaatcgaggcggggcatcacctcacccaggaagcgcaagggattgggggatttccctttcctaaccaagggatgccgtgacagactatacctggaaaaatgggacacttctgcccaaatagtgggctttttccacagtcttagcaacaagcagaccaggagattctctcccatgcctggcttgacggatcctatacccatggagccttgctcagtgctagcacagcagtctgagatcaatctgcgaggcagcagcctggcagggggaggggaatccaccattgctgaggcttgagtaggtaaacagagcgcccaggaagcttgaactgggaggagcccactgcagctcagcaaggcctactgcctccatagacttcagctctgtgggcagggcatagctgagcaaaaggcagcagaaacttctgtggacttaaacgtccctgtctgatagctctgaagagagcagtggttctcccagcatggtgtttgagctctgagaacggacagacggcctcctcaagtgggtccctgacccccgtgtagcctgactgggaaacacctcccagtaggggctgaaagaaacctcaaacaggcaggtgtccctctgggacaa

SEQ ID NO: 289312 - DNA, 476 bp, Homo sapiens
acccctgcaagggaaacggcatgcacgtctagtctgagcacagacagcacagcagagtgcagactggagaacgttaagaataacaaaaccagtttcagtctatcagtaggccagtagctactcttcagtttccacaatagtatctattatggggaggtgttggggataacatcactgatgttatcgcttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcagggtgggggataagggggatcctctag

SEQ ID NO: 289313 - DNA, 2156 bp, Homo sapiens
gctaggactaagtgagcttctcccttcttgttgtagaggaaatccgaaaaactgcctggtttgccacctcaccctacctcccccacgagcgaaggagtgcgtgcggctttactcccagcccgactggtccactcccagaaaagcctcggtgggactccgacgtctagggagttgtagccgctaccagaaatatcgatgagcctttaccctgaggtttagaaaggcagctctttctggggcaaatacaaagagcgtgtttcttcctacaaattagtggcatcctcccgctgtatggattcagctggcaaagtaactcaagccttgtcctgactgcaagggtgggcggggtggacggctcggtgttctgcccgttgtgtcttacgctccaggtgctggtctacgcgggcctggacagtcaggggtaggagcgggagccgagaggaggcggaggagatggcgtcccagccgccacctccccccaaaccctgggagacccgccgaattccgggagccggaccgggaccaggaccgggccccactttccaatctgctgatttgggtcctactttaatgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagtatgttggtctggtgacctggttacattttattatacacattattggaccataaggacatttgtttcacctagattttaagattatggagactgctgtcatttttatcttatttaaatctctaggtttattggaagagtaagattgatgaactatagcatgcacagtttggtacagtagagatcattaatacttttaaaagttctacattaattgacttggaatccttagaaatggagtggtgacatgtcagtatgagaacaggcaaaaggtaaatttttttttttttttacaaccttaagtaatctcaataataaaattttctgatctgtattaaaac

SEQ ID NO: 289314 - DNA, 2605 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccactatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289315 - DNA, 2923 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccactatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289316 - DNA, 926 bp, Homo sapiens
gggatgcctcttacttggctattggcatctgggatgggtcctttaatgttcttatcttttcactccaattttccattcctttgtctttctactctattttcctggaaattttctcacttgtatctttcagaccttctgttaagattttcatttctggtagctttttttttggtggggggagggggtctcactatttcacacagactagagcacagtggtgccatcatagcttactgtaaccttgaactcctgggctcaagtgatcctctcgcctcagcctcccaagtatctgggactgcaggcatgtgtcactgtacctgactcatttttaatttttttatttttttgtagaaacaggttctcactatgttgccagggctggtcttaaattcctggcttcaagtgatgctcccacctcagcctcccagagtgctgggattacaggcatgagctacttcatctggtctcttgtagcatatttttactttccaagagtgtttttattctctgaatgttcatctttttagctgtctcctgttgttctttcatttacaatgtctttccttatttctctgagaacagcagtaactttttaaaaaaaaacagtgtgttctctattctctcctagttgttggcttatatgcaagagaggggcaccacaaatctggctgacagctctgagcaggtagatgtggggcttactggctggaagggacataggggaaccccactccccaaggagacccttttcttagggtatgtgagcaagcagcttgagtatgagtggatgctgcaaacagatccatagggcaatgtggctaggcattttgggggcactcttcctccaagcatgtttcgttccatcgtctgaatcctgcaagaaggtaacttcagcctcctgccagcatccttgggaaagagattaa

SEQ ID NO: 289317 - DNA, 481 bp, Homo sapiens
gggatgcctcttacttggctattggcatctgggatgggtcctttaatgttcttatcttttcactccaattttccattcctttgtctttctactctattttcctggaaattttctcacttgtatctttcagaccttctgttaagattttcatttctggtagctttttttttggtggggggagggggtctcactatttcacacagactagagcacagtggtgccatcatagcttactgtaaccttgaactcctgggctcaagtgatcctctcgcctcagcctcccaagtatctgggactgcaggcatgtgtcactgtacctgactcatttttaatttttttatttttttgtagaaacaggttctcactatgttgccagggctgaggtgggagaatcacccaagccagggaagtcaaggctgcagtgagctgagatggtgccagtgcacaccagtctgggcaatgggggtgagacccagtctca

SEQ ID NO: 289318 - DNA, 364 bp, Homo sapiens
gcctcatcctatttcttcaccaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccactatgaggaggccacagggccccaagaggccctggcccagctccgagagctgtgtcgccagtggctgcgtccagaggtacgctccaaggagcagatgctggagctgttgtgcacaccagtctgggcaatgggggtgagacccagtctca

SEQ ID NO: 289319 - DNA, 417 bp, Homo sapiens
cacagcagcagccctgcccagcatctgcttctgaaacagcctctccagcctggctggtgccctgctcattcacttgcatggccagaagtaccaggtacctccaactcctgagtttttagaatcttcttagccaggcgcagccgctcatgcctgtaatcccagcactttgggaggcggaggcaggtggattgtttgagtccaagagttcgagaccatcctgggcaacatggcaaaaccctgtctctactaaaaaataatacaaaaaactagctgggcatggtggcacgtacttgtagtcccagctacttgggaggctgaggtgggagaatcacccaagccagggaagtcaaggctgcagtgagctgagatggtgccagtgcacaccagtctgggcaatgggggtgagacccagtctca

SEQ ID NO: 289320 - DNA, 411 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctagggggcagggacttgtgtcgacccgcccgcgaatttagtagtagtagtcgacc

SEQ ID NO: 289321 - DNA, 2978 bp, Homo sapiens
tttgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatctttcttactgatttattgtagctctttacttaggaggttaattagccttttgcctgtggagagttttttggtttgccatttgtccttttttaattttttttgttttttggccatttgtcttttgactctgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctggtgcctcctccttcacccagcgtctgacgctggagtgctcacagtgtggctgggacccacttctctcctctgtagatacccacccctgtgttgatcacttgcaggcccgggttctgtgtgccatgtgtatgccctagagcccttgctcacgtttccccacagccttcatgaagtctgtgttcctcagatgccccacagacatcacaagcaaggcacatccaaaccccagaccactatccaggagcctgcaccctctttctgttggctccacctccagcctccgagacccacccacttccctgcatttgctgagaccatcattttccacctagacaatgcccccacgcttgccctacagcccttccaaaaacgattttttccaacctaaatcagacctagaaagctttttcacatagcccagtcttcctccttgtgctgggttctgtctcattatcacctcatcagggaagtctgtacagatagaatccctacccctgcatttgtcgcctccgtctgcctctttggtcagtttcaggtccctgtagttcacactgtgtccccagggatgaagtgggtcccggcacggtgggcattctgtcatgaatgaatggtccccttgtgtatgcagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289322 - DNA, 2936 bp, Homo sapiens
tttgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatctttcttactgatttattgtagctctttacttaggaggttaattagccttttgcctgtggagagttttttggtttgccatttgtccttttttaattttttttgttttttggccatttgtcttttgactctgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctggtgcctcctccttcacccagcgtctgacgctggagtgctcacagtgtggctgggacccacttctctcctctgtagatacccacccctgtgttgatcacttgcaggcccgggttctgtgtgccatgtgtatgccctagagcccttgctcacgtttccccacagccttcatgaagtctgtgttcctcagatgccccacagacatcacaagcaaggcacatccaaaccccagaccactatccaggagcctgcaccctctttctgttggctccacctccagcctccgagacccacccacttccctgcatttgctgagaccatcattttccacctagacaatgcccccacgcttgccctacagcccttccaaaaacgattttttccaacctaaatcagacctagaaagctttttcacatagcccagtcttcctccttgtgctgggttctgtctcattatcacctcatcagggaagtctgtacagatagaatccctacccctgcatttgtcgcctccgtctgcctctttggtcagtttcaggtccctgtagttcacactgtgtccccagggatgaagtgggtcccggcacggtgggcattctgtcatgaatgaatggtccccttgtgtatgcagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289323 - DNA, 2507 bp, Homo sapiens
tttgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatctttcttactgatttattgtagctctttacttaggaggttaattagccttttgcctgtggagagttttttggtttgccatttgtccttttttaattttttttgttttttggccatttgtcttttgactctgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctggtgcctcctccttcacccagcgtctgacgctggagtgctcacagtgtggctgggacccacttctctcctctgtagatacccacccctgtgttgatcacttgcaggcccgggttctgtgtgccatgtgtatgccctagagcccttgctcacgtttccccacagccttcatgaagtctgtgttcctcagatgccccacagacatcacaagcaaggcacatccaaaccccagaccactatccaggagcctgcaccctctttctgttggctccacctccagcctccgagacccacccacttccctgcatttgctgagaccatcattttccacctagacaatgcccccacgcttgccctacagcccttccaaaaacgattttttccaacctaaatcagacctagaaagctttttcacatagcccagtcttcctccttgtgctgggttctgtctcattatcacctcatcagggaagtctgtacagatagaatccctacccctgcatttgtcgcctccgtctgcctctttggtcagtttcaggtccctgtagttcacactgtgtccccagggatgaagtgggtcccggcacggtgggcattctgtcatgaatgaatggtccccttgtgtatgcagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289324 - DNA, 2581 bp, Homo sapiens
tttgcttattctccaccctgttccacatctggcattttttgtgtctatgaggttattgatctttcttactgatttattgtagctctttacttaggaggttaattagccttttgcctgtggagagttttttggtttgccatttgtccttttttaattttttttgttttttggccatttgtcttttgactctgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctggtgcctcctccttcacccagcgtctgacgctggagtgctcacagtgtggctgggacccacttctctcctctgtagatacccacccctgtgttgatcacttgcaggcccgggttctgtgtgccatgtgtatgccctagagcccttgctcacgtttccccacagccttcatgaagtctgtgttcctcagatgccccacagacatcacaagcaaggcacatccaaaccccagaccactatccaggagcctgcaccctctttctgttggctccacctccagcctccgagacccacccacttccctgcatttgctgagaccatcattttccacctagacaatgcccccacgcttgccctacagcccttccaaaaacgattttttccaacctaaatcagacctagaaagctttttcacatagcccagtcttcctccttgtgctgggttctgtctcattatcacctcatcagggaagtctgtacagatagaatccctacccctgcatttgtcgcctccgtctgcctctttggtcagtttcaggtccctgtagttcacactgtgtccccagggatgaagtgggtcccggcacggtgggcattctgtcatgaatgaatggtccccttgtgtatgcagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289325 - DNA, 2052 bp, Homo sapiens
ctgaggaacacagacttcatgaaggctgtggggaaacgtgagcaaggcacatccaaaccccagaccactatccaggagcctgcaccctctttctgttggctccacctccagcctccgagacccacccacttccctgcatttgctgagaccatcattttccacctagacaatgcccccacgcttgccctacagcccttccaaaaacgattttttccaacctaaatcagacctagaaagctttttcacatagcccagtcttcctccttgtgctgggttctgtctcattatcacctcatcagggaagtctgtacagatagaatccctacccctgcatttgtcgcctccgtctgcctctttggtcagtttcaggtccctgtagttcacactgtgtccccagggatgaagtgggtcccggcacggtgggcattctgtcatgaatgaatggtccccttgtgtatgcagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289326 - DNA, 2875 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccactatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289327 - DNA, 3093 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagagggtttcaggttgacttggcaccttgaagagtggaggcttggcccccaggatgaggcggccctcgaaatcgatgccacccacgggggaatgattctgcggtgccatccccttcataaacgcagattccttcctaaagccgcagctgcagaaggaacagcgcgaggagggaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccactatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaat

SEQ ID NO: 289328 - DNA, 1070 bp, Homo sapiens
  misc_feature (1063)..(1063): n is a, c, g, or t
tttgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatctttcttactgatttattgtagctctttacttaggaggttaattagccttttgcctgtggagagttttttggtttgccatttgtccttttttaattttttttgttttttggccatttgtcttttgactctgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctggtgcctcctccttcacccagcgtctgacgctggagtgctcacagtgtggctgggacccacttctctcctctgtagatacccacccctgtgttgatcacttgcaggcccgggttctgtgtgccatgtgtatgccctagagcccttgctcacgtttccccacagccttcatgaagtctgtgttcctcagatgccccacagacatcacaagcaaggcacatccaaaccccagaccactatccaggagcctgcaccctctttctgttggctccacctccaacccatcacccgttcgggatcctctanaatctag

SEQ ID NO: 289329 - DNA, 1011 bp, Homo sapiens
tttgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatctttcttactgatttattgtagctctttacttaggaggttaattagccttttgcctgtggagagttttttggtttgccatttgtccttttttaattttttttgttttttggccatttgtcttttgactctgatgtggtttttgctgatttcctttgatgtattctagtttatctgacttttctttggcgacttatggactttctctcaccactaaaagccctcactgctctctcagtcttcttgatttaacctcctccaggcttccgccttctccaggccctgattctcagttggagttgctggtgcctcctccttcacccagcgtctgacgctggagtgctcacagtgtggctgggacccacttctctcctctgtagatacccacccctgtgttgatcacttgcaggcccgggttctgtgtgccatgtgtatgccctagagcccttgctcacgtttccccacagccttcatgaagtctgtgttcctcagatgccccacagacatcacaagcaaggcacatccaaaccccagagaagccggaattccccaaaga

SEQ ID NO: 289330 - DNA, 1777 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccactatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccaggtaagtgagatggggtgtggtgggactaggccttccgcatggacagcaccatctctgccgaccccactcctggccctacgcaggcagccctcttactccagcatccccaagttcccccattccctagatcatcccctataaggttcaacctcctctagcatcttctgccctcaaaaaaagccacccaccactaccactgatcccacagcccctctactttctagaaactccccaccctagtaaaaccttttgcaagcagggcgagtattccccgtacccacattctctcccagtcctggtatcctggatggcctcctgggcttgcatcctgctggtcaggcatcaggacaggtagggctgggacctgacaaggacagcaggttagtagacagagcaggtgggcaggagggaccttgacacaggatagggatcctgcccaatcat

SEQ ID NO: 289331 - DNA, 693 bp, Homo sapiens
tttgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatggcagatgagttcagccctaaggtgcatttttcttactaggaggagatggagtgtattttatgggatataagcattagctacatttcctgtcctgttcacatcctttgcccatgtgtctatgaggttattgatctttcttactgatttattgtagctctttacttaggaggttaattagccttttgcctgtggagagttttttggtttgccatttgtcctttttttaatttttgtattttttgtagagacagggttttgtaacgttgcccaggctggtctcaaactcctgtgctcaagtgatccacctgccttggcttcccaaagtgctggtcttacaggcatcatgagccaccacacccagccataat

SEQ ID NO: 289332 - DNA, 878 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagagggtttcaggttgacttggcaccttgaagagtggaggcttggcccccaggatgaggcggccctcgaaatcgatgccacccacgggggaatgattctgcggtgccatccccttcataaacgcagattccttcctaaagccgcagctgcagaaggaacagcgcgaggagggaggtcagccccacttgcaaatggggaaacaagttctcgaaggcacagtgatctgaagatgggcggaatcagagtctcgggacttccttgcaggctcctgttccggcagtcttggagcctttgccgcccccccacccattgcgaagctcccccatccccttccaaccccagctaaatcaggaagctgaga

SEQ ID NO: 289333 - DNA, 414 bp, Homo sapiens
tttgcttattctccaccctgttccacatctggcattttttgtgcatcttccaacttaagtacacagcagcaagtgctctacatctttgggtagctacacagaaccccactgtggctcactgtggacacaccattgaaaaccttgtatgtaggtcacttagtacaaggaggaacacaactgttgaagaagtacctaaaaattgaattacttgaacaaagtgtgggacatttgctgttttgatggattttaccacactgtcttcccatttatgcttaccagcaatacataggaacacttgggtccctgcagtcagggtgtggaaatgtagactaatgcgttatatcccatgcaatacacttccatctcctcctatgtaagaaaatgcaccttagggcgtgactcatctgccattcc

SEQ ID NO: 289334 - DNA, 636 bp, Homo sapiens
gcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccactatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtgagtgagtgtccacgagtggggttcaggactggagcatcatccagctcggcctcaccctgggcagcaccacgctttgccagacacacgttctcccttgtggtacagaagtggccacctgcaacagagaccctgtgcaaggctgcccagggcagagggattccagggccagactccccagcccattcctgcatcacctgcagtcacgtgga

SEQ ID NO: 289335 - DNA, 814 bp, Homo sapiens
aagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagtgaggaaaacgtggtggggggcatgcgcgatctggtaggcggtgctgccgtctgttgtacctgagaggcttgcgcatgccgacgcacggattcgaggcggggagcatgggaagaagcggccaggagtatgacctgatcattgcgaccaccgctaggggaagggaggagagggtgtagaaacggggacgagggtgggggaagggcaaggaggcgctcgagctggtgcgcggagcatcctgggagacgtagtccagcgggagggggaagtcgaagactgcgcgtgctcaggagcgcggagcggcccgctgagcgcagaggtgagggcggggtcctcttaaccgggagggctatcgtgtggacgggggcggtggctgcagactcggggattccggctccccagtgagaccggaagcgcggggaacgaatccgggcagtccttgcgggagcgcccagggctagagcgagaggcttgtcaatcactactcgttgccacgacgacaggctttgggagccccgcccccggttgcctaggcgtcgtctggacctaccttggcaccctggagcggaagttgccgcctggacttctgggaagtgtatttcgggaccctccgtaggtacctgccatcttggctatgacccaagtctctcccag

SEQ ID NO: 289336 - DNA, 1344 bp, Homo sapiens
  misc_feature (6)..(6): n is a, c, g, or t
  misc_feature (851)..(851): n is a, c, g, or t
  misc_feature (1206)..(1206): n is a, c, g, or t
ggacgngcggcacccagagagggtcctgtactgggccggcttggggcttggttctatgtccctgcgggtcggtgcgagggcgaagaggaacccgtgggtctcgggggatcccggggggccggaccagtgttccctagttgtgggagcagatgcgtgggcgcatcagcgggcgggcagggcctgaagtgcaggtgcgggccgtggaccctggcgggggctgggatgacaggcgtgtggtcctggcagtgaagcgggttctagaggcgcaggaacgggtaggcgaggccggtggccctgggcccggagtctgcaggccaagctcctgtcctgccgcttagggacccggttaccaaccctcatgtcgctcagtttgcccatgtgtcccggtgctaacacacagttctcgggagatgttccccattcccagaggagtagtgcgaaatgcgtgctcctctagtcttaaacttggcgtttgtattagttgggtttcctggtgtctctttagcaagtgaaatttctggttccctccttcactgtgtgacctgcctagtcctcctgggtcgcatttacagaagtttatacgagacctagtttccagggaagaactcactgattccgcgagggagatggtgtaatgggtgatggtagtcagccttaagggtacttcagtcttaactgtgtgttacaaagtttgaaagggagggttccctatgaataagaagtgcacttgaaagaacagccatctggtctaacctctcactggtgcttcagaggaggaaaaaaggtcacagctatgtttccagtgtcctctgggtgtttccaagagcaacaggaaacgaataaatctctgngaccgggtctcaccatattgctctggctggtttcaaactcctgggctcaagcgatcctcctgcctcagccttccaaaaccaggtgtttaacttgggactaacatgaagcacttagaagactacgtggaacatagcaatgactatatatgtactacaacgtaaacagcacctcctggattgaatagaacataactgacatgaccagcagagacaggctaaagacactgagctgaaaaccctggactctattgctaaattgaggctcctgaatccgttcgctctgagcaactgttgctgtggtgctgccttcacaagcactctgctgagcactcagatagaggggctgtgctatccntcaacagacaagctgcagccagaactgctcagctgacaaactggtagaggtccagaaacacagttctgctgcatagtgaaaaaaggccaatttagattctttttcatagagagaaaaacataaacatgtgattgaacg

SEQ ID NO: 289337 - DNA, 458 bp, Homo sapiens
  misc_feature (6)..(6): n is a, c, g, or t
  misc_feature (387)..(387): n is a, c, g, or t
  misc_feature (444)..(444): n is a, c, g, or t
ggacgngcggcacccagagagggtcctgtactgggccggcttggggcttggttctatgtccctgcgggtcggtgcgagggcgaagaggaacccgtgggtctcgggggatcccggggggccggaccagtgttccctagttgtgggagcagatgcgtgggcgcatcagcgggcgggcagggcctgaagtgcagctatgtttccagtgtcctctgggtgtttccaagagcaacaggaaacgaataaatctctgatggagtctcactctgtcacccaggctggagtgcagtggcagattctccgcttcacttgcaagctccacctcccaggtttcacaccatccttcctgccttcagcctcccgagtttgcagggattacagggcacccgncacaattgcccggctatttttttttgttgttttttagtaggagatgggggttttcantatgttagccagga

SEQ ID NO: 289338 - DNA, 473 bp, Homo sapiens
  misc_feature (6)..(6): n is a, c, g, or t
ggacgngcggcacccagagagggtcctgtactgggccggcttggggcttggttctatgtccctgcgggtcggtgcgagggcgaagaggaacccgtgggtctcgggggatcccggggggccggaccagtgttccctagttgtgggagcagatgcgtgggcgcatcagcgggcgggcagggcctgaagtgcagctatgtttccagtgtcctctgggtgtttccaagagcaacaggaaacgaataaatctctgccataggagttttagccaattcagaggccttgctccccacaatttggaaaattcctttggatttgaccaagtcgggaagagacaggagaaaagtgaaacaacaccaataaagccccaagcataaacaaacaaaaagagttaagcaaaacaacaaatgcccaattcatatgattactgagtgttctaatggtaaggagaaactaaaagccgaaatttaaagcca

SEQ ID NO: 289339 - DNA, 741 bp, Homo sapiens
caagagcaacaggaaacgaataaatctctggtgagttgtttatttgttcttcactttgttttacactgtattttctgagtttattggtgtctgtgaattaaaaaggaaaagtagaaataagtaaaactcaggttgaaggaaatatacataaataagataaagctgacctgtagatataggcaggttgtaagagcttagagttgtctaagttgggtgcaaattttcctctgatctttctgatgccgagacaaaaaaggcagtcatatttgttacgtgattggaatggaatccgagaagagagcatgctgtgttcttgtgggacaggaaagcttctgtgcaccaagtcagaaccaccaccttcattggtgacatagattatgtgctggaacatatttcacaccggcctggcagtaaccacttgtagtgttgtgcagtggaaacggtcatcttccgctaaagcacggcgtttagtgcagtggaaatggtcatctgccagtaaagcacagcttccatcgtaaggtatgctccttgctcaaagagtgtggtcccaaacagcttttgggaggtcctccttgattcatggatgaaacctggaacatcttgaggactgagttaaccataggtccttaaataactctccacacctttttcttagtttatctctacatgcagggtgtgcagcagcctgttcaaagtcatattttctgggaaatatttccagtgtttatttgcactttagcc

SEQ ID NO: 289340 - DNA, 550 bp, Homo sapiens
gtttacagaattccggcatcataagctatcatatgagaagcaagatttcagaaccttttttaaacacaagtgcttgagattgtttgaacaatgtgtgtcaagacagactactaacacagaaacacctcactgaaagaaacaacaaaaataacaacaaagaggtttgatgactggcttacagagaagaataaggaaatgtacctctaagaatcgtttgaaatgagtcttcatatcctcccaaatatttttcaagaacgtttggcattacttcaaaaattaactttaggaaaggaactattatcacattttaagaggggaattgcagttgcacttaaactagaaacttccacttggtgaattgaattattaaggaataatggcagaagaaagagtaagtcgtttataggcaataataagcaataaaaatatatgtatatgtgcatgcaaaaagttatggcaaaactaataagattttaaaaaatcattgtgttcctgaagaaacaaagaactggttttcttctaaggaattaaagagttttgtttctttggc

SEQ ID NO: 289341 - DNA, 968 bp, Homo sapiens
  misc_feature (783)..(783): n is a, c, g, or t
  misc_feature (793)..(794): n is a, c, g, or t
  misc_feature (809)..(809): n is a, c, g, or t
acaaacattcattgtctaggataccatgatgggtgctggggtggcagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagaggtngctcaatcannttgttgacatcgaantatgcatcccgggtggggggcagtggaatggggcccggctgggccagatggtccgtttctgtcggactcaaaagtcctttgcttgaatgggcaggaatggaaggccgccagagtggggggcgaaagtggcaagacttcaaggaaagaccaacgccgggg

SEQ ID NO: 289342 - DNA, 476 bp, Homo sapiens
ctggttgaggacaatgacatggatgccccggccctgctcccgggcctcatcctccagcacctacacagtggcagagacaaagtccagcttttcactctggcattcaaggtgtctctgtcttaggggtacttaaaacaccagctgcttgaaacatcacctcctgcctatgtttctgttcacacagttcttttccaactcagctcgaaggccacctcttccagaaagcctctatagcactcccatcagaagagatcacgtctttctacaaccctcccctccatgactttcatggctcttagagcctctgctgtctctgcttcatcctggaagtatcacaatcctccaccacactgaacccctcaaggtagggccaggtctgattactttcaggtccccagtgcccagcacaaggctgaggccaaagaaaggaccaggggatggttataaaataaatcaatgaattgactgcctactat

SEQ ID NO: 289343 - DNA, 400 bp, Homo sapiens
ctgtggaagacgggtaggctgtggaagaagggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccgtctcacagcctacccgtcttccacacactacccgtcttccaggtaccggctgatatta

SEQ ID NO: 289344 - DNA, 1329 bp, Homo sapiens
caggcgtacggtctgagacttatgatcctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 289345 - DNA, 1532 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 289346 - DNA, 1945 bp, Homo sapiens
caggcgtacggtctgagacttatgatcctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289347 - DNA, 1919 bp, Homo sapiens
aaatggctagacgaggcctgggttaatcggcagcaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289348 - DNA, 1912 bp, Homo sapiens
  misc_feature (10)..(10): n is a, c, g, or t
cctgttacgncctggattatgggatgcaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289349 - DNA, 1901 bp, Homo sapiens
ttacggtctaaggagcgaggaccgcgtgaatcggccgatcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289350 - DNA, 1757 bp, Homo sapiens
acaaacattcattgtctaggataccatgatgggtgctggggtggcagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289351 - DNA, 1795 bp, Homo sapiens
cgggagtgcgttccagagggtccccggagggtgtgatatcattggcatgagagcatgaggatcctgattcaatattgtcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289352 - DNA, 1989 bp, Homo sapiens
  misc_feature (10)..(10): n is a, c, g, or t
  misc_feature (14)..(14): n is a, c, g, or t
  misc_feature (16)..(16): n is a, c, g, or t
aagtaaggcngggntnatcggccgaggggctgattcatccactgaagccctgggccgggaggctttcctctaagatctgtgggaactgcgcagggccctcctcaatctaggcctcagaattccccctgaggtttggagttgagctagacagcctttaagagaagctctggctgtattcccactggtacctcactttcctcttgtgaggcaaggaggtcttgtctacatgaggggcgggcctgaagttggattctggaggggagccaaatggggcctcagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289353 - DNA, 2185 bp, Homo sapiens
  misc_feature (10)..(10): n is a, c, g, or t
  misc_feature (14)..(14): n is a, c, g, or t
  misc_feature (16)..(16): n is a, c, g, or t
aagtaaggcngggntnatcggccgaggggctgattcatccactgaagccctgggccgggaggctttcctctaagatctgtgggaactgcgcagggccctcctcaatctaggcctcagaattccccctgaggtttggagttgagctagacagcctttaagagaagctctggctgtattcccactggtacctcactttcctcttgtgaggcaaggaggtcttgtctacatgaggggcgggcctgaagttggattctggaggggagccaaatggggcctcagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289354 - DNA, 1953 bp, Homo sapiens
acaaacattcattgtctaggataccatgatgggtgctggggtggcagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289355 - DNA, 2460 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggtgagacactgggatggaggaagggaagaagattgggcaaaaccctgggagtgggctgtggcctgtgaatgggcaccttctgtaccagcccctaaacactggcctgcctcacccaggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289356 - DNA, 2089 bp, Homo sapiens
ctcagctgtgtggtagtaagctacttgccagcactgtttaaggcctgcctgacctctctctccccagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggtgagacactgggatggaggaagggaagaagattgggcaaaaccctgggagtgggctgtggcctgtgaatgggcaccttctgtaccagcccctaaacactggcctgcctcacccaggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289357 - DNA, 2224 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaaggggtaaggttggctgggggaggttttagggtggagagaaagaagcaaggccccacctccaccctcatcttgtctccagctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289358 - DNA, 2119 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289359 - DNA, 2340 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggtgagacactgggatggaggaagggaagaagattgggcaaaaccctgggagtgggctgtggcctgtgaatgggcaccttctgtaccagcccctaaacactggcctgcctcacccaggctgagcacttcctgacgttgctggtagtgcctgccatcaagaaagattatggttcccaggaagacttcactcaagtgtggaacaccaccatgaaaggggtaaggttggctgggggaggttttagggtggagagaaagaagcaaggccccacctccaccctcatcttgtctccagctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289360 - DNA, 1065 bp, Homo sapiens
caggcgtacggtctgagacttatgatcctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 289361 - DNA, 973 bp, Homo sapiens
caggcgtacggtctgagacttatgatcctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataatgaaatcagcagagcctctgggtggatgtgtagaaggcacttcaaaatgcataaacctgttacaatgtt

SEQ ID NO: 289362 - DNA, 2156 bp, Homo sapiens
  misc_feature (10)..(10): n is a, c, g, or t
  misc_feature (14)..(14): n is a, c, g, or t
  misc_feature (16)..(16): n is a, c, g, or t
aagtaaggcngggntnatcggccgaggggctgattcatccactgaagccctgggccgggaggctttcctctaagatctgtgggaactgcgcagggccctcctcaatctaggcctcagaattccccctgaggtttggagttgagctagacagcctttaagagaagctctggctgtattcccactggtacctcactttcctcttgtgaggcaaggaggtcttgtctacatgaggggcgggcctgaagttggattctggaggggagccaaatggggcctcagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289363 - DNA, 1375 bp, Homo sapiens
cggccgcctactactactaaattcgcggtcgagtcgactgagagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgttaaaaaaaaaaaaaaaaaaacaaaaacaaaaaaaaaaaaaaaaaaaaaaaaaaaaaagcaaaacaaaacgactgggtgggaggcccagcgaatacagtggtacacactagtgagtggcggcggacgacaagagaaggcaacaacgtacgattggacggggacagacgaggggggccacaacacagagacagagaccaatataacaagagagcggcgtaagcagggcagctggctcggatcctacgcaggcaccttcgagggagaggagcaacgccacacgtcgacgcggaagcgaacacagacgggagcagacagcagccacaacaaccgacgggagagggagggagctcagacgaagcggcgggcgcacggaatctgaccgactgacaagagtacggcagggagaaccgaccaaccgccactcagaaggggcggacagcagcgccaagtgaacagacgagggtggcgcgcgcgagcacggcacgcccaaaaagcacgcagggccatgcgagcaccggccagcgcagcgagcgagcagcggagacgcaccagagagaagcaagcagacgagggagcggaggcgacgacgcggccgaacagcacccacgaccgagaga

SEQ ID NO: 289364 - DNA, 1148 bp, Homo sapiens
caggcgtacggtctgagacttatgatcctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagttcttttccaactcagctcgaaggccacctcttccagaaagcctctatagcactcccatcagaagagatcacgtctttctacaaccctcccctccatgactttcatggctcttagagcctctgctgtctctgcttcatcctggaagtatcacaatcctccaccacactgaacccctcaaggtagggccaggtctgattactttcaggtccccagtgcccagcacaaggctgaggccaaagaaaggaccaggggatggttataaaataaatcaatgaattgactgcctactat

SEQ ID NO: 289365 - DNA, 1013 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccatgtactcgcaagaggttcttacaagtcacgaccttgtaagtacgagggtctgcttcaaatcagctgatgtatgccaagctgt

SEQ ID NO: 289366 - DNA, 1200 bp, Homo sapiens
  misc_feature (10)..(10): n is a, c, g, or t
  misc_feature (14)..(14): n is a, c, g, or t
  misc_feature (16)..(16): n is a, c, g, or t
  misc_feature (1015)..(1015): n is a, c, g, or t
  misc_feature (1025)..(1026): n is a, c, g, or t
  misc_feature (1041)..(1041): n is a, c, g, or t
aagtaaggcngggntnatcggccgaggggctgattcatccactgaagccctgggccgggaggctttcctctaagatctgtgggaactgcgcagggccctcctcaatctaggcctcagaattccccctgaggtttggagttgagctagacagcctttaagagaagctctggctgtattcccactggtacctcactttcctcttgtgaggcaaggaggtcttgtctacatgaggggcgggcctgaagttggattctggaggggagccaaatggggcctcagctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacggtgtgtgaaacccagctccacaggctgatgaccaagagtcccctcgcccttgacaccaggccctgggattcccaaaccctgctttggacccccctaggctcaggcttctgtctcacttttccgggggggggattagggcaaggagggcatgagggactgtctctccctaaaacccagacccctgttccccactcagttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagaggtngctcaatcannttgttgacatcgaantatgcatcccgggtggggggcagtggaatggggcccggctgggccagatggtccgtttctgtcggactcaaaagtcctttgcttgaatgggcaggaatggaaggccgccagagtggggggcgaaagtggcaagacttcaaggaaagaccaacgccgggg

SEQ ID NO: 289367 - DNA, 830 bp, Homo sapiens
ccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacaggtaaaggattagattggattaagcagaggctgatcaacccctgaggtgggttcaaggccggatgattgaagggtgtgcagaccatgcctacaggtgtttcatctgcaaaatatagaactctggggtgtttgtatattttctccttactcattttaaaacaagtatttgttggcggagtggtggagtcccactgcctggacacaggaggccaatgctatggggtcaaaggagttagtcttttgtggttatagcctggctcctaacagtgcatttctgtttatcacaaatacttagggattttcacaattctagaggacccctaataacacattaatgggcatggtaggagttgaaagaagtgaatcttgcatctaaaagtaaattacatgttatatgttctttgaaaaaa

SEQ ID NO: 289368 - DNA, 1579 bp, Homo sapiens
ccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcgtagagatggggtttcaccatgttggccagactgctctcaaactcctgacctcgtgatccgcccgccttggcctcccaaagcgctggattacaggcgtgagccactgcgcccggcctcctcctttttgattatgtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 289369 - DNA, 2384 bp, Homo sapiens
gtgaatggcctcatttatgatcagaggaatgcagattaaatccatatgaaacactagttcttccagaactgcacaatttaaaagcctgacagcatgaaatgttagcaaggatgtgaagcagctagattcataaacttgctagtcatgtaaaatagtaccactactttggaaaactggaactttttaacgttaaatgtgtaactcttctattactcagcagttccactcctaagtattaaatatttaccaaaagaaacgaaaatatgcctataaagccttctattagaattaactgtgctgttattcattgcagcattgttttgttcgttgtgtatccattgtttttttaatagtaagagactgaaaacagcctcaatgtcccattactaggagaccatttaatttatagtcattgctatactatctagctgtggaaaaatgagaaggatctttatgtattgatatgtttctgaaatgtattattatgaaatgtaaaaagcaggatacaatccagtatacatatatatttttaaagtgtgtatagatgtggatagaatatctctaaaggtatatttaaaaaaatgtttggtgtcagttgcccttgagaagggttaagataaagaagataaagggtgagataaaaaaagagggactttccacagtttacccttttgtactttttgaattttctatcatgaatgcaatgctatacacaatataatttttttaaaaaaatcctatacttagaaatgcagatttgagatcagcaaaatcagaaatttaagaagatgtggcattctaagcagagaggtctaaaactgctgataagaacactttgaataatgtgaacctgacgtgcccacctgatttatgggataatctaaaactattattcccaaatactaaactggctacatcagaatcacctggggagctttgtcaaaatacctggcctctagttctgagattttattattgttcattagaccagtgctagggcatgaatgttttgtgtttatctttttttttttttaacttttattttaggtttagggatacacatgaaggtttgttccataggtaaacatgtgtcacagggatttgttgtacatattatttcatcacccaggtgtgaagcccagtactcaatagttatcttttctgctccttttccttctcccaccctcccctctcaaatagactccaatgtctattgtttccttctttgtgttcataagttcttatcattacctcccacttataagtgagaacatgcggtagttgattttctgtttctgcattagtttgctaaggataatggcctccagctccaatgttttgtatttaaaagcctccaagtgactcctggcttagccagctgtggaaaccactggactaaaacaagcatgtccttacaagcttccattcgttccatgttttggtcttttttggttgaagttgtttaggaagtactgtgtttgagtttattcatttctttatgcattcagaaaacattggtcacctgttatacattatacgcctattacacatgaggtttttaatgtatttagacctgacaataggagtgtcacttagatgtgatctcagtgttgtgggtaactttgtttgtctttaatgagaaatctggaacatagatgatgattttttcctttgaattaacttaatgtgttctcttccctacagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 289370 - DNA, 4778 bp, Homo sapiens
  misc_feature (4777)..(4778): n is a, c, g, or t
gtgaatggcctcatttatgatcagaggaatgcagattaaatccatatgaaacactagttcttccagaactgcacaatttaaaagcctgacagcatgaaatgttagcaaggatgtgaagcagctagattcataaacttgctagtcatgtaaaatagtaccactactttggaaaactggaactttttaacgttaaatgtgtaactcttctattactcagcagttccactcctaagtattaaatatttaccaaaagaaacgaaaatatgcctataaagccttctattagaattaactgtgctgttattcattgcagcattgttttgttcgttgtgtatccattgtttttttaatagtaagagactgaaaacagcctcaatgtcccattactaggagaccatttaatttatagtcattgctatactatctagctgtggaaaaatgagaaggatctttatgtattgatatgtttctgaaatgtattattatgaaatgtaaaaagcaggatacaatccagtatacatatatatttttaaagtgtgtatagatgtggatagaatatctctaaaggtatatttaaaaaaatgtttggtgtcagttgcccttgagaagggttaagataaagaagataaagggtgagataaaaaaagagggactttccacagtttacccttttgtactttttgaattttctatcatgaatgcaatgctatacacaatataatttttttaaaaaaatcctatacttagaaatgcagatttgagatcagcaaaatcagaaatttaagaagatgtggcattctaagcagagaggtctaaaactgctgataagaacactttgaataatgtgaacctgacgtgcccacctgatttatgggataatctaaaactattattcccaaatactaaactggctacatcagaatcacctggggagctttgtcaaaatacctggcctctagttctgagattttattattgttcattagaccagtgctagggcatgaatgttttgtgtttatctttttttttttttaacttttattttaggtttagggatacacatgaaggtttgttccataggtaaacatgtgtcacagggatttgttgtacatattatttcatcacccaggtgtgaagcccagtactcaatagttatcttttctgctccttttccttctcccaccctcccctctcaaatagactccaatgtctattgtttccttctttgtgttcataagttcttatcattacctcccacttataagtgagaacatgcggtagttgattttctgtttctgcattagtttgctaaggataatggcctccagctccaatgttttgtatttaaaagcctccaagtgactcctggcttagccagctgtggaaaccactggactaaaacaagcatgtccttacaagcttccattcgttccatgttttggtcttttttggttgaagttgtttaggaagtactgtgtttgagtttattcatttctttatgcattcagaaaacattggtcacctgttatacattatacgcctattacacatgaggtttttaatgtatttagacctgacaataggagtgtcacttagatgtgatctcagtgttgtgggtaactttgtttgtctttaatgagaaatctggaacatagatgatgattttttcctttgaattaacttaatgtgttctcttccctacagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatgacaacgcgtgtttctgttgtgtgcataaaaggggaaaagaacgggtatttcccttcaatgtatttaactaaatagcaaaaacattaaacagaacgtaagaattttaaaatttcctttgaaaaatcaactattaaccatacttttcctaaaagaccacatatcagaatatgcatatgaaaagttaaaaatttgttagtggtagttattgaaaatataataaaacatcttttaactatcagtgtcactatacatagggttttttaacaaagaatttggctcgtactaattttgacatgacatctgacttacatgtctaatgccattgcataaagtagatgtgttcttacagctgctctaatctctgtgccttgtgctttttttaaaaaacatttaagtctttactagaggcctaaaataaagtcaaataatacaatacttcagattcttcagtagtccatatttatacaactgtaattccatcagtcttgtaagggtacttgaactacaaaaagaaaaaaagagatatctctataagagttttgatttttctccaaaggtaaatttttaaaaactaagatcagcaatactttttccatcaccttcatctttaaatttgcagtcttaaattatttgacttaccagaaaaatcacaacttgctaataaatcattgaatggccatggctattccacaaattattgttatttttaggaagataaattctgttgaaatacaaaactgcacaaatcataaaggtatagctcaatagtatgaaaatgtcagtttttaaagtttgcaacttcagaaaactcatttttaaaccttagagacttttctagctttaatattgtactctttaagccatacacaattttaacatctctctaaaccatatctactcttttcctgaaatctagtgactgcctattcaaacatgagcatgtttgtttattagtgtcacaagggagatgcgttttatcaattttttttaaccaaagttattgaaagaaaaaaaggaaaaaaaaattactttcagagtcatcacactgcttccttatgggtccttgagagttttgtggtgataatgacagatttgtaggtgattggcgtaaagttggaaagtttcaagtatttttatcatgaagttagcagacagaatttatttattgctttgcttatgagcaaattggtcctcatctgtaggtttttcatctgtatttaaccatgtatggaaaatactcaaaaattaaaaaaatacaaattttaaaatataactacattgcattaggtattatctagatttaaaggatgtacataggttatatgcaaatacgaagccattttatataaggcacttgagcatctgaggattttggtatccaggagggtcctggaacaaatcctccaaggatactgagggatgactatataggtttgttgggaaaatcagaagcataatagtgtaaagaaggaagtgttatttttggcacatacctagtagccagaacattccacgttactacaaaatctccttaattagttctgacgattaaatgacagggcctcttggggaaaccactagttttgaattcaactgcatacaggtagatgttattactcatagaagattctgccagtgtttcgactacccatcctccaccttgtcctgaaacttatttagagcaaaagaaagctctcataaatatggcttttccaatctattcctaatgaaataaaactgtcactcagcaactgggtcttaagttctagcaagcatggggtacaaaagtttgccaaacccttttttagtagtaattatgactctaggtgctttgttctcttaagtttgtctcccttagacaactccaaggtggctcttaaaacatgactacataatttcagcttgaaagccttatcgggctatttcaagcaggagtggtttatcactgaacaataatttgtttaaattctccattttatttttgtatttgtaggcataactgcaaagctctaaattttataggttaaacttggatatttgaaaaaaaaagttttagtaagttctatcacattaatactaaagcagtgcttatttctggtttattagtataatatttatctcaaagtatttaactttttagtaaacttctgtggttccaagttaagataataaagcatttatgttgacttctcagctaacagaggtatgtgttaatttcttattttatgattaggaagagggaaaaatacaaacacctaccatgtacagtttattgtgtagccattctgtccattttacagataatagtaaataatttttttaatttttattactacatggcaacaacttatttaatcatcacagcctcagggggtatgtaccattatcatcccnn

SEQ ID NO: 289371 - DNA, 1447 bp, Homo sapiens
ccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 289372 - DNA, 3841 bp, Homo sapiens
  misc_feature (3840)..(3841): n is a, c, g, or t
ccgcgagccccctgcgcgccgctttggggctgcgctcactcgtgtgcgcgctcgtccgcccgccagtcctctcaacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatgacaacgcgtgtttctgttgtgtgcataaaaggggaaaagaacgggtatttcccttcaatgtatttaactaaatagcaaaaacattaaacagaacgtaagaattttaaaatttcctttgaaaaatcaactattaaccatacttttcctaaaagaccacatatcagaatatgcatatgaaaagttaaaaatttgttagtggtagttattgaaaatataataaaacatcttttaactatcagtgtcactatacatagggttttttaacaaagaatttggctcgtactaattttgacatgacatctgacttacatgtctaatgccattgcataaagtagatgtgttcttacagctgctctaatctctgtgccttgtgctttttttaaaaaacatttaagtctttactagaggcctaaaataaagtcaaataatacaatacttcagattcttcagtagtccatatttatacaactgtaattccatcagtcttgtaagggtacttgaactacaaaaagaaaaaaagagatatctctataagagttttgatttttctccaaaggtaaatttttaaaaactaagatcagcaatactttttccatcaccttcatctttaaatttgcagtcttaaattatttgacttaccagaaaaatcacaacttgctaataaatcattgaatggccatggctattccacaaattattgttatttttaggaagataaattctgttgaaatacaaaactgcacaaatcataaaggtatagctcaatagtatgaaaatgtcagtttttaaagtttgcaacttcagaaaactcatttttaaaccttagagacttttctagctttaatattgtactctttaagccatacacaattttaacatctctctaaaccatatctactcttttcctgaaatctagtgactgcctattcaaacatgagcatgtttgtttattagtgtcacaagggagatgcgttttatcaattttttttaaccaaagttattgaaagaaaaaaaggaaaaaaaaattactttcagagtcatcacactgcttccttatgggtccttgagagttttgtggtgataatgacagatttgtaggtgattggcgtaaagttggaaagtttcaagtatttttatcatgaagttagcagacagaatttatttattgctttgcttatgagcaaattggtcctcatctgtaggtttttcatctgtatttaaccatgtatggaaaatactcaaaaattaaaaaaatacaaattttaaaatataactacattgcattaggtattatctagatttaaaggatgtacataggttatatgcaaatacgaagccattttatataaggcacttgagcatctgaggattttggtatccaggagggtcctggaacaaatcctccaaggatactgagggatgactatataggtttgttgggaaaatcagaagcataatagtgtaaagaaggaagtgttatttttggcacatacctagtagccagaacattccacgttactacaaaatctccttaattagttctgacgattaaatgacagggcctcttggggaaaccactagttttgaattcaactgcatacaggtagatgttattactcatagaagattctgccagtgtttcgactacccatcctccaccttgtcctgaaacttatttagagcaaaagaaagctctcataaatatggcttttccaatctattcctaatgaaataaaactgtcactcagcaactgggtcttaagttctagcaagcatggggtacaaaagtttgccaaacccttttttagtagtaattatgactctaggtgctttgttctcttaagtttgtctcccttagacaactccaaggtggctcttaaaacatgactacataatttcagcttgaaagccttatcgggctatttcaagcaggagtggtttatcactgaacaataatttgtttaaattctccattttatttttgtatttgtaggcataactgcaaagctctaaattttataggttaaacttggatatttgaaaaaaaaagttttagtaagttctatcacattaatactaaagcagtgcttatttctggtttattagtataatatttatctcaaagtatttaactttttagtaaacttctgtggttccaagttaagataataaagcatttatgttgacttctcagctaacagaggtatgtgttaatttcttattttatgattaggaagagggaaaaatacaaacacctaccatgtacagtttattgtgtagccattctgtccattttacagataatagtaaataatttttttaatttttattactacatggcaacaacttatttaatcatcacagcctcagggggtatgtaccattatcatcccnn

SEQ ID NO: 289373 - DNA, 1161 bp, Homo sapiens
atatgctcctaggttctctaccagggtatttttttattactattttattactcaccttggcaagtatgaatagatattacggcgtttatgattaaattcatttaaatccattaacgtaactccactttgttgtagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatga

SEQ ID NO: 289374 - DNA, 846 bp, Homo sapiens
ctctttctgagggtggtgatcccccatcacggagtgtcctggtggcggtgtacggtttcgaacacttcagtccacaaggataacaaccaacattttcagagcacttggcaatttacaaaatacatctgcctgaaggtacagcactaccagcctcattttacgtgtgtgaaaactgaagcacagaagaattgggtgacttgtcagacgctgcataggtggtcagcattatggtcttcatccctccatcaaccttaatcacatactgcatgtgaccagcaggaagaggggtcttgagaataggaggggagatcaaagaagacatcgtcgtctatttgacatcaaaactggccagtaagtgcacaagaaatgagctgggttacctggaacctaaccttgggaagatgatctgtcaatggagctgtatgtctgtgtgagactggattttcctcatatactgtgaacaaaacaacatataacagattgactgcagaaacaggtcaagcttgtctaccaataaggagaggcacaggtacgggacacttttgaagggtttgttcgccttcagacaaacagcagacacctccacgctttgttttccacggcagagatggctagactctctttttggtcccagggagtggagctggctcgctctacacgctgcttctcacctgaggatatcagtggaaaagccccagtcctgggcacaggcatggctgtggacatgggcatgagctttatggggctgccactagctggccagaaacactgccctaagagtggacagatggaggccatggtaatgacctgctcattgtgccatcaggacctgccaggtatgggctc

SEQ ID NO: 289375 - DNA, 882 bp, Homo sapiens
ctctttctgagggtggtgatcccccatcacggagtgtcctggtggcggtgtacggtttcgaacacttcagtccacaaggataacaaccaacattttcagagcacttggcaatttacaaaatacatctgcctgaaggtacagcactaccagcctcattttacgtgtgtgaaaactgaagcacagaagaattgggtgacttgtcagacgctgcataggtggtcagcattatggtcttcatccctccatcaaccttaatcacatactgcatgtgaccagcaggaagaggggtcttgagaataggaggggagatcaaagaagacatcgtcgtctatttgacatcaaaactggccagtaagtgcacaagaaatgagctgggttacctggaacctaaccttgggaagatgatctgtcaatggaggataaattcccagaagtgagactgctggattatatgctgtatgtctgtgtgagactggattttcctcatatactgtgaacaaaacaacatataacagattgactgcagaaacaggtcaagcttgtctaccaataaggagaggcacaggtacgggacacttttgaagggtttgttcgccttcagacaaacagcagacacctccacgctttgttttccacggcagagatggctagactctctttttggtcccagggagtggagctggctcgctctacacgctgcttctcacctgaggatatcagtggaaaagccccagtcctgggcacaggcatggctgtggacatgggcatgagctttatggggctgccactagctggccagaaacactgccctaagagtggacagatggaggccatggtaatgacctgctcattgtgccatcaggacctgccaggtatgggctc

SEQ ID NO: 289376 - DNA, 2348 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggtatggcattcatgtttcattattacactgactctctttttattaaaacaattcttatggta

SEQ ID NO: 289377 - DNA, 802 bp, Homo sapiens
gcatagtagtgttgacattttaacctacagatccaatacatatctctttttcctttttaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaactggtagactggagctattaaattctccttctcttgacccgaactctgttttgttgtggtgacagagttgctccataagc

SEQ ID NO: 289378 - DNA, 1351 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggttgattattttcttactgttagaaaaggggtgtgggggtatggctctataatgtttttaaataatttagtatttattatttaaaatctgattatatatgtacatctgcatacatatatataatatcttggtatgaacatgtgatacttctgctagggtttttttaatgttctaatagtctgtaaaattacaaagacaacaaatagcattcattttgaaatatcttgtgttctatatttagatctggctcagctttgaaaataatatatagtagcaatttcatgtatcattgcctgtggtttgcttcattcattaaccttctatattcaaatcaaaactatagaagatatttctatagtatgaaattttatgtgacattttagtttataacagatgatagagtcattttttaatttaatgaaaaggaaaggttttacaaagagatgcacattatagtcaccaattttttgacacaattgtagttgtcaataatatttttcttatggttatttctctttgtcctgtctgtgttacagctctccagactaatatagagaatactaagtaacatgtctctaagatgacagctactaattcctgttaccttcactttcactgaaatgtgtgctatttagggaaatgaaggacattcctccaggagagtttaagggaatgtagaggggctagatgtgattatctggtgaaaaggggacaggaagaaggggaaatcagttagaagaaagaaaataaggaaa

SEQ ID NO: 289379 - DNA, 6682 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaataaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctggggacatatgactagaaatgaaaacaggtgttcaagcaaaaactttcacgcaaatattcattgcagcac

SEQ ID NO: 289380 - DNA, 6111 bp, Homo sapiens
acggccgcctccggagcccgacgcggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaataaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctggggacatatgactagaaatgaaaacaggtgttcaagcaaaaactttcacgcaaatattcattgcagcac

SEQ ID NO: 289381 - DNA, 3486 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtca

SEQ ID NO: 289382 - DNA, 4456 bp, Homo sapiens
gcatagtagtgttgacattttaacctacagatccaatacatatctctttttcctttttaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaataaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctggggacatatgactagaaatgaaaacaggtgttcaagcaaaaactttcacgcaaatattcattgcagcac

SEQ ID NO: 289383 - DNA, 5881 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggtatggcattcatgtttcattattacactgactctctttttattaaaacaattcttatggtaaaacagatcccctcaatcttgtccaatactgaaatatatggcataaatatgacaatcacgttttgattagcgatgagaaaaagaggcaatgtttaattttataacataattaaaatccagaattacctttgagatgtaagttaatactcagagaaattattaattatctgctaccacttgcatgatgaagtgttctagcctgattaaagctgataggactactggagggctgcaacaatgggaggggagactggaaaataaaaacaaggatagtagtcagaaaactttgaacaacttgcccatgtgtgagcagtcggatttttaaatactcaacccattgatatctgggagcagattaaagtcctgataacctaatgaagatggcaaccctaaattacactgagtaagaaacctgatctggcagtcttactaacagaaagaatttcacccttgtgtatttctgggagggtctagcacttctaaaaatgatcttttgagatctttgcttccatcatcaccaagaacagaatcaggaatttgtgcttgtgtcacccagttcagtacttggtacataaaagacaataaatgtttaactgagccaagattttcttgtatacaaggagccatgataagtatggtcaagaaaacaaagcttctaggccaggcatggtggcttatgcctataatcccagcactttgggaggctgaggcgggcagatcacgaggtcaggagttcaagaccagcctgaccaatatggtgagaccccatctctactaaaaatacaaaaaaattagccgggcatggtggcacgtgcctgtaatcccagctactcggggggctgaggcaggagaatcgcttgaacccaggaggcagagcttgcagtgtgccaagatcgcaccactgcactccagcctgggtgacagagcgagactccatcaaaaaaaaataaataaataaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctggggacatatgactagaaatgaaaacaggtgttcaagcaaaaactttcacgcaaatattcattgcagcac

SEQ ID NO: 289384 - DNA, 3952 bp, Homo sapiens
ccgtcgcgaaaggtatatcttagtatatcattaaaatagtgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataatatttgctaatattgtttattgtgaactaggaatcaaagtttttgtatgcatcaatgcacttaatccttataacaaccttatgaggtagttctattccctttttatagctaaggaaattggggtacagagaagttagccccaaggttatatattgcaagtaagtggcagagcagggattcatacaaagaccttctcactcagcagtcttcactcttactattcctgccactaggtagaaaaagaaagatttcggccgggcacagtggctcacgcctataattcccagcactttgggaggctgaggtgggcggatcacgaggtcaggagatggagaccatcctggctaacacagtgaaaccccgtctctactaaaaataaaaaataaaaaaaaattagccaggcgtggtggcgggtgcctgtacgcccagctactcgggaggctgaggcgggagaatggcgtgaacccaggaggaggagcttgcagtgtgccaagatcgcaccactgcactccagcctgggtgacagagcgagactccatcaaaaaaaaataaataaataaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagaaaagtagatgcaatataatatatttcaagttttatacatattagatgaattgcatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctggggacatatgactagaaatgaaaacaggtgttcaagcaaaaactttcacgcaaatattcattgcagcac

SEQ ID NO: 289385 - DNA, 5827 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggtatggcattcatgtttcattattacactgactctctttttattaaaacaattcttatggtaaaacagatcccctcaatcttgtccaatactgaaatatatggcataaatatgacaatcacgttttgattagcgatgagaaaaagaggcaatgtttaattttataacataattaaaatccagaattacctttgagatgtaagttaatactcagagaaattattaattatctgctaccacttgcatgatgaagtgttctagcctgattaaagctgataggactactggagggctgcaacaatgggaggggagactggaaaataaaaacaaggatagtagtcagaaaactttgaacaacttgcccatgtgtgagcagtcggatttttaaatactcaacccattgatatctgggagcagattaaagtcctgataacctaatgaagatggcaaccctaaattacactgagtaagaaacctgatctggcagtcttactaacagaaagaatttcacccttgtgtatttctgggagggtctagcacttctaaaaatgatcttttgagatctttgcttccatcatcaccaagaacagaatcaggaatttgtgcttgtgtcacccagttcagtacttggtacataaaagacaataaatgtttaactgagccaagattttcttgtatacaaggagccatgataagtatggtcaagaaaacaaagcttctaggccaggcatggtggcttatgcctataatcccagcactttgggaggctgaggcgggcagatcacgaggtcaggagttcaagaccagcctgaccaatatggtgagaccccatctctactaaaaatacaaaaaaattagccgggcatggtggcacgtgcctgtaatcccagctactcggggggctgaggcaggagaatcgcttgaacccaggaggcagagcttgcagtgtgccaagatcgcaccactgcactccagcctgggtgacagagcgagactccatcaaaaaaaaataaataaataaaaaataaaagatttcattttatgtgaggaattattttaataaaaaaaagagggtttatgctctatagtaataaaatttaccagtaacacccaatcagaaaattttggttccttagtatttagggaagacttttgtttaaatctcttatggaattttacatgttttgatttagatggtattttaggcaacttaactataaacaaatttattcatagaagcattgttgccaacaatttagatgacctcgatgaaaaaacacaccaattgacaaaactggctcaaaaggaaataaaaaatccaaacagacctgtaacaagtaaagagattgaaccagtaatcaaaaatctcccaacaaagaaagtccaggactaaatgagtttactggcaaactatgccaaacatataaagaagaattaacactaatccttctcgaactctcccaaaaaatggaagagaaaggagcaccctgtgacattctataaggcggacattaccttaacaccaaagccagacaaagacctcacagggaagctacagaccaatatcccttatgaatatagatgcaaaaaaacttcaaaatactagcaggccaaatccagcagcttattaaaatgatcacacagcatgaccaagtgagatttatcaaagaaatgcagggatggttctacatacaaatgtcaatcgatgtaataatataccatattaatagaatgaaggggaaaaaacagcatgatcacctcaattgataagaaaaagcatttgacaaaaatccaacaccctttcatggtaaaaacactctgcaaactaggaagaaaagggaactttcttaacctgataaagacatccataaaaacccacagctaacaacataatagcaaaacattgaaaatttttcccctaatatcatgaaaattcctgatttccccactgctattcaacattatactagaaggtctagccagagcaattaggcaagaaaaagaaataaaatgaatcccaaataggaagaagtaaaactacatttgcagaaaacatggtcctatatattaaaaatcctaaagaatccacaaaatgattccggctgattttaaaaattcagcaatgttgcaggttgcaagatcaacacacaaaagtctaagaaaaacctgaggggaaattaaaacaatttcatttacaataacatgaaaaagaataaaatacttagaaataaatttgaccaagaaagtgcaagacttggacactgaaaagtacaaaacgttgctgaaagaaattaaagaagacctaaataaatggaagacatcctgtgctggcaggttggaagacttaacattgttaagatggcattactcccaaaattagtctatagatttaatacaatccccattaaaattccagtgacccttttacagaaactgaaaagctgaccctagaatttatatgggattgcaagttactgaaggtactcaagtctgttcaaaacaatcttgaacaagaataaagttgaaggactcacattttccaatttcaaaatttactgcaaagctacttcaatcaaaacagtgttgtgctggtataaaaatatataaagcaatagagtagaatggaaagtccagaaacaaattacgccaatacactatggtcaattgatttttgacaagggttccaggaccattcaatgaagaaagaacagtgtcttcaactaatagtgctaagacaagtgaatattcacatgcaaaagaatgaatttgtacctgtacttcataccatatataaaaattaattcaaaatagatcaaagacctaaatgtaagagctaaaaccataaaactttgagaagaaaatacaggaataaatcttcatgaccttggatttggcaatggtttcttagatatggcaccaaaagcacaagcaacaacagcaaaaaaaaaaaaaaaaaaaaaaaatcaaaattaaaagcttctacatatcaagggacactatgaagaaagtgaaaagacaacccacagaatgggagaaaatatttgtaaatcttacatatctggtaaggaactaatacctagaatatataaggaactccgatgctcgacaacaaaaagacaaaccaattttaaaatgggcaaaggacttaaatagacatttctctaatgaagatatacaaatggccgacaagcacatggaaagcactcaacctcatcagtcattatgcaaatcagcgccacaagaagataccacttcacacctattagaatgacgaaatagacctaggatctaaacctacaggaaaaaaaaatgaataatagagaaaataaatgttagagaggatgtggagaaattgaaaaccttcattcgttgttggtgggaatgttaaatggtgtagccactgtggaaaacagtttggcagttcctcaagttaaaaaaaagaattaccatatgacccagcaagtccactcctggggacatatgactagaaatgaaaacaggtgttcaagcaaaaactttcacgcaaatattcattgcagcac

SEQ ID NO: 289386 - DNA, 3783 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggtattttcacatacttttgaggacagcaaagatcacctggtggccatcaagcagaccatctggaggcaaaactccttatctgaggaattcagaagtcattagactgccctattatctaaagccggcatcttgtactaggcttctttaccaaaaatgtatttaataaaacatttccaacctgtgaaaaaaaaaaaaaaaaatttttttttttttgcttcaaagagcttttctcagagcagggatttattttcattacatgcaacatggacaaacactgttctggttttcatgacaatttgaattcaaagtaatatgtttttctaaaattcagtgtatttatttggccatatggatgctccttgtgttcttggtcacatattaaagaaactggcactttggctgcaagaacaaataaaaaatatcataaatccaactggtctttgatttgggtctaggttaataactaaagaaccattcagcaataatggcttgaacatttatatatcctatgaaaccgcaattagttaagaggctgctgattctaataactatgacaccagcaagggagtgaggggagaaatgataactctggatgccaaattcagagcaaagtatctattatctccttctcacttttgcagtatctataaataaagtggtggggggagaattatatgaataatgttaaataaaagtgcatacagaactgagaaatattttcatggaatttgccacttagttcttaaaattcttataaggaaaataaccatttacaacaaaagactagttacactgttgctgtttagaacatgagagcaaaatgagtaacaatcaaattctctggtttaaacttaattatcttaaaacatgttattctgtaagttgacatctatgccttgaaaattcaaggcagaaagtaaaatcatttagaaagccagaaattccatcaatacatctagacagatgtttgcttgtagtttttggtatccaaaaccttttttccacacatcgcacagatgccttttttgtaggcacagccctggcagtaatgagaacctggttggtgcacagaacttttacaaattctacaagtggagaacttattctttccatatggatcaaatcttgctttttttgaagtcaaagctttattttcattcagctttcttccaccactttctgtggtattcctagcaccacctttccatgtatctggagtgataacagtaccaagtttcttttcacatttttcgcacaccatccttccccacgacacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatcttttt

SEQ ID NO: 289387 - DNA, 3772 bp, Homo sapiens
  misc_feature (3771)..(3771): n is a, c, g, or t
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcagtgaattgttattgtttgcaaaaatgcactgggcagtaacattttgtgataaatcctataagatataagtcattgagatgtctaagatgctttttattttaaccccagttaataaccaccttacggaaaataattggtagtttggtatgggaacaggaacacaggttgggtggctaaggctaaccttaaaccttgggtgttaccttttagcagaatgggacaaaatcccagtatggcaaggggacggcaaacacttccaggctatcgccgcaaaaaaaagcggagcccaacacgggggggacaagagacacacgcaaaaaagggggggggggggcatataaaacggaataatcgggna

SEQ ID NO: 289388 - DNA, 3606 bp, Homo sapiens
  misc_feature (3492)..(3492): n is a, c, g, or t
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatccttatgttctcaagtctgtatctgcctcccctgccttatttcttatgttttgccacagttaacccattgtgcttctttgtaatcaaacagtttgtgggagaatgggcttattgaatgtctaaaaaataagtttaaagtgtttgttaccctaagttttttacatttttaaactctaattacatatgtgaatgttattactctcaaaaacatttccaacctgtgaaaaaaaaaaaaaaaaacctcgtgccgaattcggcacgagcttctaagcaccacatggntaagagggcaaaagttttgcacctatgatggtattttaggtggtataaataaatccacttttgtctattggtaactattttggcaaattaatttttgggtgtaataactggggc

SEQ ID NO: 289389 - DNA, 3630 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcattaaatttaagatatgcaaatttatgtagagaaaataaatgttatataccctataatctttcacctaattagtatttaattatatggatttgttttatattataaaagatgttttgattttgtcttttgatattgacaaaattgtttggatatcctcgtgatccgcctgcctcggcttcaaagtgctgggattacaggtgtgagccaccaacccagcaatgttttcttaataagtatagttttctagggaaagttaattcatttttgtctagtacatatatgtccactctatccactgttgtaaggtcggtcactgtagtcacggagatgtacatagaacttcatgaggtatatagatactcatctgtctaggcagttccccaattttctgaagaatgttacacagcaaatttctattgctttattaatagtgcccgtcaaccatgtcccttccagacatagttcatcaattctagcgtatatagactggcggaggcatggttctggtgccatacctgtctcgctttactatgcccatctgtttgcgtgacaaaccttttcaatcataaacca

SEQ ID NO: 289390 - DNA, 3135 bp, Homo sapiens
  misc_feature (3061)..(3061): n is a, c, g, or t
  misc_feature (3098)..(3098): n is a, c, g, or t
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagatatgatcccaaaacagacatgtggactgcagtagcatccatgagcatcagcagagatgcagtgggggtctgtttacttggtgataagttatatgctgttggggggtatgatggacaggcataccttaataccgtggaggcttatgatccccagacaaatgagtggacccaggttgctccactgtgcctaggaagagctggagcttgtgttgtgactgtaaaattataatttagtgccccgttttctacatgaagacaccgtcttcctttattaatttagtataattattctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttactttttgtaagcttatcataaatgagttgcagtaatttgtttgcttgtttgtttaaccacaaccactattttaatgatatactaaagataacactatttagttttttcagaaacatctgcattatatgtgtgttggttgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagttgaagttgaaacatgatgttttgcataantgtatgacaaagaatttacatgccccgcggaggggtntcaatgcttcaggcacgaatatataaatgaaaaatcc

SEQ ID NO: 289391 - DNA, 2219 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaaggagcaacaagcattgaaaagtatgatctccgtacaaatatgtggactccagtagcaaatatgaatgggaggaggctacagttcggtgttgcagtgctagatgacaaactgtatgtggttggaggaagagatggactgaagactttgaatactgtagagtgctacaaccccaaaacaaaaacttggagtgtgatgccacctatgtccacacatagacatggccttggtgtggctgtactggaaggtcccatgtatgccgtaggaggacatgatggctggagctatctgaacacagtggaaagatgggaccctcaggctcgccagtggaattttgttgccactatgtctacccctaggagtacagtaggtgtggcagtactaagtggaaaactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaagtgcgaaaaggattatgatcccaaaacagacatgtggactgcagtagcatccaatgaagcaaatcaagccaaggagatgccaaggttgggaggagaggttcattgg

SEQ ID NO: 289392 - DNA, 1550 bp, Homo sapiens
tgtttcatctttattcattatcctttgttctttaaaatctgatatattggcataaaagtaattgtacatatatatatgaatgtgatttattttcctttacatctttttgttgtgtacagcagggcatatacttctcttgtcttggttggatgcacaaatctgtgtgcagtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggacttccaatagtagtcagacattatcatcctgtcatactatggagccatgtacatcagatgaatttttccaagcccttaatcatgccgagcaaacatttaaaaaaatggaaaactatttgagacataaacagttgtgtgatgtaattttagtcgctggtgatcgcagaattccagctcacagattggtgctctcctctgtctcagactattttgctgccatgtttactaatgatgtcagagaggcaagacaagaagaaataaaaatggaaggtgtagaaccaaattcgttgtggtccttgatccagtatgcttatacaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggagcatttcatggaagtaatcagaaaccaggaatttgtattattaccagccagcgaaattgcaaagctcttggctagtgatgacatgaacattcctaatgaggagacaatattgaatgcacttcttacttgggtccgtcatgatttggaacagagacggaaagatctaagtaaacttttggcttatattaggctacctcttcttgcaccacagttcctggcagacatggaaaataatgtactttttcgggatgatatagaatgtcagaaactcattatggaagcaatgaagtaccatttattaccagagagacgacccatgttacaaagtcctcggacaaaacctaggaagtcaactgttggtacattatttgcagttgggggaatggattcaacaaaagaacaagctttggaggctcagtttcggggtgcgctagt

SEQ ID NO: 289393 - DNA, 108 bp, Homo sapiens
actggaataggggattatgtcttgtaatgttcataatgcctaataaacccctgtaagtggtttacatgtttctttttactttcaaaaaggtactgtaccccacgctat

SEQ ID NO: 289394 - DNA, 4044 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctccccaaaaaaaaaat

SEQ ID NO: 289395 - DNA, 644 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaacagggtctcgctatttgttgcccaggctggagtgtagtggtgtgaacacagttctctgcagcctcaacctcctgggttcaagctgtcttcccacctcagtctcaagataattattttcgttcatctacttattaaattttttaaactaaggcatgtagt

SEQ ID NO: 289396 - DNA, 727 bp, Homo sapiens
ctgagggtagaggagccccattgggaggctccactagaggaccctcattgggaggagccagaggagcacaagcggccacaaggctattcctgaccctcagcccggctagtgcatccgccagctgccctcagcccgctgaaaggggactctgtctctgtctttcaggagttcatccgtgagggctgccttcacaagctcaccaagaagggcctgcagcagaggatgttttttctggtaggttctctccccactcaagctgtgcttccccccgagggggatgggcagcagttctgttagggacatcgcctgcagcggcagcccattggcctctgggtagtttagcacttggaggctttggtccaggtgggtagcgttggagtcagacagggccaggggagggtcacagagtgggaagaagcagaaaacagcttccccacccaccccagggccagcctccttcttcattccaggttctgagcacctgactatgggacaaacagaagccaaaagattgtaaagtccacatacatgtggctgcaagaaggtgctactgatggcccaatggccagtcgggacagtttcacaggaaccagtgcatctgctgggtcagctcccagctagcttggctgagaagctggaggcagtaaggaattctggctggtgttggctcagaagcccctcccagcatgtccttgttcctaccagttagtgggttccagcctgaaac

SEQ ID NO: 289397 - DNA, 3278 bp, Homo sapiens
cgtgcacctgtcgtcccagctactcaggaggctgaggcaggagaatccgcttgaacctgggaggcagagttgcagtgagccaagatcacgccattgcactccagcctgggcacagagcaagatcctgtctcaaaaaaaaaccttactgatttttaattttggaattccctatcgtgtgatctgcttcctaaatgtactttctcttgtccaatacttcattcttgaattaattaacctttgtgttttgtttctagggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctccccaaaaaaaaaat

SEQ ID NO: 289398 - DNA, 2839 bp, Homo sapiens
ctagatcgtgtagtatgagaacgaattccgatataaatgaaggacagactacatgcacaccacagatcccgatcgacgctctgtactgcagtagctagcaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctccccaaaaaaaaaat

SEQ ID NO: 289399 - DNA, 2345 bp, Homo sapiens
gttgcgttcttctcaggtattgcgtttcttcttcaccacagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctccccaaaaaaaaaat

SEQ ID NO: 289400 - DNA, 3892 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctccccaaaaaaaaaat

SEQ ID NO: 289401 - DNA, 1620 bp, Homo sapiens
tttggttactgaacactgactttattgtgcacagggaaagggaactcactttacttggtgcctggaatgtcactctaggtttttaacatgcttctgttggacttaagtactgataaagctgctgttcatagcagtccagaggtaaaaccaaggcctcagctggagaaagcatgcagaggcttagtcttggggagcaaacccactcccacaaggggtcctgggtgctggttaatgcacctgcatttttcctttattgacagaaccagctttcaggatatctgctaagaaagttcaaaaacagtcatggctggcagaagctctgggtcgtctttaccaacttctgtttgttcttctacaaaactcatcaggtactggagtttcactggagcccaatgcaggtgatgctagcagacagacacttaaccctgctcacctgtgtcccttttgtattttggttctgccctcccatgctttgcccacacaccctgtgctgtgtgaacagggaaactggctcccttggcccgtgggcatttgtacgtgccaccgttgtgcaggtagcagaggaatgggcattccctgtggcaacccagcccctggaacccgtgtccctatgctgtcttgcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctccccaaaaaaaaaat

SEQ ID NO: 289402 - DNA, 1084 bp, Homo sapiens
cgctggtactgagccgcgaattcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcagggctggaggggatggtcagggggaaggaggaatgacgctcaacctgcccaggtttggacacaactacaaagaacagcaggacacagaggtgacctctgtcctgaggcttctcaacagatgggaagtggctgtggtctcactggatccccactggcaccagcagtgtgggtgggcctcatgtaacatctgggaggggcttcatccccccacccaggacctagtgcatgccagcagctatctggggccctgggaaaaatgtgcgagtcttgagcgcggagccgctcaagccacagctcccaggcccctggctcaaagacgcagacaaggcctgagcagtgctctcggcatcggaccaaagcctgggcacaccctgcctctctccccagagcagggtccctgccgaggactggcctagagcaagcactggaaaagaggccctgccatacaccctgcgtacccactgccaggaccctctcagacaagcgtggcacagccatgctgaccttccatctggtgaaccaagtggcagccccaggggcctgccctgcaggtcacagctaaacaagtctggcagaagccacgcttgttccccatgtacctctagagaagcagaaaccaaagtccccctgtgccctgggagggtggggccgtctaatttattactgcccagcattccttccaacgggaagtagatgggcgactgctttgttcacacacatttgattaaaaataaacaaacagcatctccccaaaaaaaaaat

SEQ ID NO: 289403 - DNA, 3334 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggagtttaccagctacttccaaagacatgacgaggtcctaacagaactggaaaaggctaccaaacgctgtaagaagttggaggcagtgtacaaggagtttgagctgcagaaggtctgctacttgcctctcaacacgttcctgctgaagcccatccagcggctgctgcactaccgcctgctgctgcgccgcctatgcggacattacagccccgggcaccatgactacgctgactgccatgacgccctgaaagccatcacagaggtgaccaccacactacagcacattctcatccggctggagaacctgcagaagctaacggagctgcagcgggacctggtgggcatagagaacctcattgctcctggcagggagttcatccgtgagggctgccttcacaagctcaccaagaagggcctgcagcagaggatgttttttctgttctcagatatgttgctgtacacaagcaaaggagttgcagggaccagccacttccggatccggggcctccttcccctccaaggcatgctggtggaagaaagtgataacgagtggtctgttccacactgtttcaccatctacgcggctcagaaaacaatcgtggtggcagccagcactcggctggagaaagagaagtggatgctggacctgaactccgcgatccaagcagccaagagtggcggtgacacggcccctgcactgccaggccgcactgtgtgcactcgtccccccagatcccccaacgaggtatctctggagcaggagtcagaagatgatgctcggggtgtccgcagctccctggaggggcatggccagcaccgggccaacaccacaatgcacgtgtgctggtaccggaacaccagcgtgtccagggcagaccacagtgcagctgtcgagaaccagctttcaggatatctgctaagaaagttcaaaaacagtcatggctggcagaagctctgggtcgtctttaccaacttctgtttgttcttctacaaaactcatcaggatgactacccactggccagcctcccgctgctgggctacagcgtgagcatccccagggaggccgatggcatacacaaagactatgttttcaagctccagttcaaatcccacgtctacttcttccgggctgagagcaagtacacatttgaaaggtggatggaggtgatccagggggccagcagctcagccgggagggccccaagcatcgtgcaggatggcccccaaccctcctcaggctgagatgtcaggggaagagtttgctcttgggacctctgatcgacccgca

SEQ ID NO: 289404 - DNA, 2409 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctgggaagggccctccaaagcccacacaaaaggcagtcatcaacgaatcggggacatcctgctcaggaacatgcgccagttaaaggctgctcatgagttcaccacgtgaccgcccaaggtgtggagctctgcataacaccatgaagctgagccacagtgacgacgacgactcaagctccccctcctccatccctcgcctgtcccaccttctacccaatcctgcgagactctggccactcctcacacctagagttcccaagggactataggttttgctgttctgtgttgagatagccccacttgaagaactgcattcagcctaggtgcccttttcctgcctcgacggaagctgagtcaggttgttaatgagaaagttctacttatcccaaaggcagttgcactaatttaaaattgaaatatacacaaatctgtttgatccagattatca

SEQ ID NO: 289405 - DNA, 2021 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggcctttccacgaagagtcctcagccttctccctccagccggaagagccccctgagtctgagccctgcatttcaggtgcctttgggcccagctgaacagggctcatccccactcctgagccctgtcctcagtgatgctggcggagccgggatggactgcgaggagcccagacacaagcgcgtgcctgcagacgaggcctacttcatagtcaaagagattctcgctacagaacgaacatacctcaaggatttagaagttattaccgtgtggttccgcagcgcagtggtgaaggaggacgccatgcctgcgactctgatgacgctgctcttctccaacatcgatcccatctatgagttccacagaggcttcctgcgcgaggtggagcagaggctggcactctggtaacaccccttcagcccccacacgggagactcccacaccaactcatcatcaccgct

SEQ ID NO: 289406 - DNA, 1713 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccagggcaccaccaaaatcaacactttcaactggtccaaggtccgtaaactaagcttcaagaggaaaagatttcttatcaaacttcatccagaggttcatggaccttaccaggacacattagaatttttgttgggtagtagagatgaatgtaagaacttctggaagatttgtgtggagtatcacaccttttttagacttttggaccaacctaagccaaaagcaaaagccgtcttcttcagccggggctcctccttcagatacagtggaagaactcagaaacaactagtagattatttcaaagacagtggaatgaagagaattccatatgaaagaaggcacagcaagacccacacgtccgttcgagctctgactgcagacctaccaaaacagagcatctcattccccgagggattgaggactcctgcctccccatcttcagcgaatgccttttactcgctctctccctccactctggtcccctctggcctgccagagtttaaggacagcagcagctccctcacagatccccaggtttcctacgtcaagagtccagctgcagagaggcgcagtggagcagtggctggaggccccgacacaccatcggcccagcccctcgggccccccgcactccagcctggtccaggtgtcgggttttgtcatgtcgtgagcagctgtggttctgtctgtgctggggggcagagtttcagtgccttagacctagacacagggagggccggtagggagctcagcgctgcttgtaaaaatgacaatggtggggatgactttaccaca

SEQ ID NO: 289407 - DNA, 1121 bp, Homo sapiens
cgctgcgcgggggctgccggcgggcagttgggagcaggcgacgccgacgcgagtctggcggctgctgcttgcgactgcggaggccgggcgaggccggtgaggacgcggcgggcgagcgagaggccgaggtgttttcttcactcatggtgaagaatgggggagatagaaggaacatacagagtcctgcagactgcagggatgcgcttgggtgcccagacccctgtgggagttagcacccttgagcctgggcagactctcttgcccagaatgcaagagaagcacctgcacctcagagtaaagctgctggacaacaccatggaaatatttgacattgagcctaaatgcgatggccaggtattactgacacaagtgtggaagcgtttaaacctggtagaatgtgactacttcgggatggagtttcaaaatactcagtcctactggatttggcttgaacctatgaaacccatcattaggcaaatacgaaggccaaagaatgtggtgcttcgcctagctgtaaaattttttccacctgatcctggtcagctacaagaagaatatacaagatacttgtttgccttgcaacttaagagagacctgctggaagagcgtttgacctgtgctgacaccacagcggcccttctcacgtcccatctcctgcagtcggaaataggagattacgatgaaacgctggaccgagagcacctcaaagtgaacgagtatttgcctggccagcagcactgccttgagaagatactagaattccatcagaagcacgtgggccagacacctgctgagtcggatttccaggtgctcgaaattgctcgaaagttggaaatgtacggcatcagatttcacatggcttctgacagggaaggaaccaagattcaactggcagtttcccacatgggtgtactcgtgttccaggtaggccagtggggaagggaggggtgagaacagggcaggggaggttttctgcaacctggtggggtttgttcttatagatgttagtaaatatttgtcctgatgagtacgggcctcgatttggaagaggggctttgcatatcatccaatccaacctcttactcagtggggagcccactgcttcctgggactgcctcccg

SEQ ID NO: 289408 - DNA, 407 bp, Homo sapiens
attttttccacctgatcctggtcagctacaagaagaatatacaaggtaaagagctcacagagctgaagctgttgtcagcaggaatcttgtattcacctgttatctcccacagcacctggctcattgaaagaatgaataagcctgatatacacagaaaagtgaccatgagtgtagagtggttaacagaagcatgttggcagttgacccttgcacaaacacatgtgaataagacttcagtgtaaggtttacagtacaaatttgaaaataaaaaatggaatgggatgttagggtcatgttgaacttacattttccaaatgaacatagatttatgcatgttcataaggttctcagggattttgctcatatatacttatttatcaataaaatatacttaattggtagaagta

SEQ ID NO: 289409 - DNA, 378 bp, Homo sapiens
gtcgtgcattgactgttcaggggtctcactcttgcttaacgtgcctggaacagttctccctccctctcaggctgctcatgagttcaccacgtgaccgcccaaggtgtggagctctgcataacaccatgaagctgagccacagtgacgacgacgactcaagctccccctcctccatccctcgcctgtcccaccttctacccaatcctgcgagactctggccactcctcacacctagagttcccaagggactataggttttgctgttctgtgttgagatagccccacttgaagaactgcattcagcctaggtgcccttttcctgcctcgacggaagctgagtcaggttgttaatgagaaagttctacttatcccaaaggc

SEQ ID NO: 289410 - DNA, 381 bp, Homo sapiens
cggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagagctttgctgttccttgatcatcagtccgaaaggcggtatcacacagactctgcagccacactgcctacgtttgagttctgggtctgccacttgttagctgtgaaaatgagcagcttccttaaacactggtgattctctgtctcgtctgtaaaatgcacatcaccacctacttgagtgttgaggattcaattagttaatgtacttcaaataatcatgtagtaaatgctcagtagtgtgtg

SEQ ID NO: 289411 - DNA, 410 bp, Homo sapiens
cggccggggaagatggtggaggacggcgcggaggagctggaggatctggtgcacttctccgtgtctgagttgcctagtcgcggctacggcgtcatggaggagatccggcggcagggcaagctgtgcgacgtgaccctcaagagctttgctgttccttgatcatcagtccgaaaggcggtatcacacagactctgcagccacactgcctacgtttgagttctgggtctgccacttgttagctgtgaaaatgagcagcttccttaaacactggtgattctctgtctcgtctgtaaaatgcacatcaccacctacttgagtgttgaggattcaattagttaatgtacttcaaataatcatgtagtaaatgctcagtagtgtgtgaataaaaaaaaacaataaccacaaaaaaa

SEQ ID NO: 289412 - DNA, 824 bp, Homo sapiens
gtctgggaccacgttctgagagccatggttgtagggtgatggacctgtcgtttttctgtgggatgtgttcaaagtccgtagatcttcctccaggcttcttcctaggtggtataagcctggctgttattttgggagccttatggtaggagaggtctggaggttctcccttctgtatgcagactttcacttaatccccctaaatggtaccacttccttgtcttctgtggtgccctggttacccagatccagaggctcttgttcatcctgtctgaagagtaaacctccagtcttctgcagttgcttgtctggggagggggaccagtacttcctgatttcggcccttcttcttgctcacaacttcagaggaaactggtacctccagtggttccattttggaggggattcttcagtggcttgccatccgcaatactcagtatcctctaagtcagttactactcatgtgtcttcttttcttcttctaaaattttgttgacccttctaaaattttgttgacccttctaatgtgctgtctctctctgcatctttttccttcagagctttgctgttccttgatcatcagtccgaaaggcggtatcacacagactctgcagccacactgcctacgtttgagttctgggtctgccacttgttagctgtgaaaatgagcagcttccttaaacactggtgattctctgtctcgtctgtaaaatgcacatcaccacctacttgagtgttgaggattcaattagttaatgtacttcaaataatcatgtagtaaatgctcagtagtgtgtgaataaaaaaaaacaataaccacaaaaaaa

SEQ ID NO: 289413 - DNA, 2657 bp, Homo sapiens
aggccccaggaaatttcggcaaggagggcgccggggcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacttgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacat

SEQ ID NO: 289414 - DNA, 2599 bp, Homo sapiens
aggccccaggaaatttcggcaaggagggcgccggggcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacttgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacat

SEQ ID NO: 289415 - DNA, 2585 bp, Homo sapiens
tagttgcaaactggcacaaaggtgaatgcggttcatgaggctcgcttgattaagaagagctgaaacaggagcaaagagcaaaaggcaacctgcagcgaaagcaaggactcagggaaccggcagacacaagcagcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacttgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacat

SEQ ID NO: 289416 - DNA, 2759 bp, Homo sapiens
cgcgcaagggtggcgcgcgcgcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattggtctcactctgtcaccgaggctggagtacagtggtgcaatcacagctcacggcagcttcaaactcctgggctcaagcgatcctcctgcctcaccctcccgagtagctgagactacagcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacttgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacat

SEQ ID NO: 289417 - DNA, 2436 bp, Homo sapiens
aggccccaggaaatttcggcaaggagggcgccggggcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagttacttgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaagattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacat

SEQ ID NO: 289418 - DNA, 1598 bp, Homo sapiens
ccttcctgctgttccctcattgtctccagcagcctgcctcagagagtgtccccttcccccagcgtcgttctcaccttacccctgtgcacctttgcctggcaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacat

SEQ ID NO: 289419 - DNA, 1833 bp, Homo sapiens
aggccccaggaaatttcggcaaggagggcgccggggcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacttgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacaggctgccgtactgaggtgatgggccaagctggagatatccccaaagcccatgttgacaccctgtcctgcaagcggatggactctgtgggctgcatccctaagaataaagcagagttcaggtgtgacctctggcagcaaagtgagaagggagtggccctgctctgttatcgtcttacccaatgagcgccacccgaggcctgacgtactcagcagcatgtcccaacccaagaggaaacagaactcggcttttggcatccaccctggctacgcttgggggcagctggcgagccgagaccttagtgggcttcagaaggctgacagcatactgcagcatggcaccagctgtgtcgatgaagtcc

SEQ ID NO: 289420 - DNA, 408 bp, Homo sapiens
gcctagtttcttctctagtttcttagggcaaaggaatgagttttgccaaaattttatctaggaaaaatggagtagttttctaagtcttacaggacactgtcaaaatatggaaatctattttattgccttagggaattctttttttttttttttcctttttctctaggtaaaggagatcttcaggaagtcacctttcctggtaccaaagggcagtgttagcatcatggatggatccgacgaaggtgggagaggtgttgatatgcgttccagggggagaggggcaggatcagtgaaagatctaactaaaggaactggggccaggaataaacagaaggaatgagatagcaggaaatagaagacagggagaagggaacatgtgctctagacatggaatttagagaggaaaaa

SEQ ID NO: 289421 - DNA, 3335 bp, Homo sapiens
tctgtgagggcagagcctgtggtgcaggaaggctggacctgcaggctcctcctggacagtgaaactgggcacttggggtccagaggcagggccttccttgacagaattgtgtcctctcctctcagagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacaggctctgcggaaggcactggagcctgctttgagtgacatctctgtggactggtttgtgcccgacactgtggaggcactgctgaccccccgggagatcccagcactctaccctggggaccagctgctcggttactgctcactcttcagggtggatggcttccggtcccgcccaccagggggccaagagcctggctggcagagctcgggtgggtccgtgtttccatccccagaagaggccccgtctgctgccagccctggcactgagcccactggcacctcagagccactgggaacaggcactgtctcagcagaactgtccagcccatgggctgccagggactcggagcagagtactgatgctctgacagacccagtcacggatcctggacccaacccctctgacacagccatatggcgccgcatctttcagtcctcgtacattcgggagcagtatgtgctcacccactgctctgccagccccgagccaggcccaggctccacaggcagcagtgagtccccaggctcacagggccctggctcccccgaaggtagtgctcccttggagcccccttctcagcagggctgccgcagtctggcctggggagaacctgcaggctcccgctcctgtcccctgcctgcacccacaccagctccattcaaggtgggggccttgagtactgaggtgctgggccgtcagcacagagcggctctggctggccgaagcctctcatcccctccaggccgggcaaaccaagtccccggccgaccccggaaaccctctttgggtgcaatactagatggcccaagtcctgagccaggccaacagttgggacaaggcctggatgactcaggaaacctgctctccccagcccctatggactgggacatgctgatggaaccacccttcttattcacggctgtgcctcctagtggggagttggcccctccagcagtgcctccccaggctccacgctgccatgtggtgatccggggcctgtgtggggagcagcccatgtgctgggaggtgggtgttgggctggagacactgtggggacctggagatggctcacagcctccctcacctcctgtaagagaagctgcttgggaccaagcactccatcggctgacagcagcctctgtggtccgggacaatgagcagctggccctccgaggaggggcagagaccacagctgaccggggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggtagagagccacagtccccaaatcctatgcaataaagtgcctcttagggactgcttgag

SEQ ID NO: 289422 - DNA, 1640 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
ngcncnancagtccccaaacaaacctaggagctaaataaaacagtgtgtgcagtgtgcaaatggagctttatgtcctccagcctgcttcctgcttctctattcctcctgcccgggaggagtagagaattctggagccaccttagtgggcaatgggggagctcctgatggttcaggagcaggaaatttatgagcagagtggggtcccaggccacagggagatgtctatccacaagggatggtggccaagggttgaatggaaagaggcaggcagggggagaggggcagagggtgtgggtattcccagggccttgagagtggacatggccccttctcctcagccttccattagcaaggatgtcactgctgctcttgcctgatgacagccagatctgttcacagttagtctgcctctcctgccatcattcatctcatgcctccatcctgcgtcaccaatgcattagcctagtgccaacacgcaaagtcccccttgcccaggctccctgacccaatgcctgcttccacatctagcttcctccctctcctctgcttccagcatgctctgaccccatttctcacccatcataggtcatcttgtcttggatctggcccaggcccggtccacgttggtgctgcccacaggcattatcgccgcggctggcaccatgacggtgaccctgcacagcagccgggagctgccctcaaggcctgacggggtgctgcatgtggccctgcccactgtgctcaccccgctggccccgccaggcccgccggggccccccaggcctccggggctctgtgacgacaggttgggcctatggtgattctcttcgtccctccctcggcttctctgggtctagtgcgggtgagggggcactggcagggtacccagggatgggaagggtgaggaagggctggggccagtcagccggagggtttaggggccttcacagtggcccagtgaccctcctcatgctcccttccagccccaccagctgcttcggggtgggcagccttcaggaggaagggctggcctgggaggagctggctgcccctcgggacgtgttctcaggccctgcccgctgccctgccccatataccttctccttcgagatgctggtgactgggccatgcctgcttgcaggcctggagagcccctctcatgctctgcgggcagatgccccccctcatgccagctctgcagccaccatctgtgtcacactggcagagggccaccactgtgaccgggccttggagatcctgctgcaccccagtgagccccatcagccacacctgatgctggagggcggcagcctgagctcagcagaatatgaggcccgggtgagggcccgccgagattttcagaggctacagcgaagggacagtgatggggaccggcaggtaccgccataggagcctggcctggcccctggccttggctgcatttgtgcacaaggagcaggcaagcaggcttacattggaatgggtgcggggaggcctcttttctcggtaagatctctccacagctgccaccaaccatcacagaggacagatgagtattgtcattggagggccgatgtgaatctctctggggtgtgtctcagaggatggaggctaggtctgatataaacagaagacagcc

SEQ ID NO: 289423 - DNA, 970 bp, Homo sapiens
tctgtgagggcagagcctgtggtgcaggaaggctggacctgcaggctcctcctggacagtgaaactgggcacttggggtccagaggcagggccttccttgacagaattgtgtcctctcctctcagagccccatcagccacacctgatgctggagggcggcagcctgagctcagcagaatatgaggcccgggtgagggcccgccgagattttcagaggctacagcgaagggacagtgatggggaccggcaggtgtggttcctgcagcgacgcttccacaaggacatcctgctgaaccccgtgctggcgctgagcttctgcccagacctgagctccaagcccggacacctggggacagctactcgggagctactcttccttttggatagcagcagcgtggcacacaaggatgccattgttttggctgtgaagtccctcccgccccagacgcttatcaacctggccgtgtttgggacgttggtgcagccactcttcccagagagccggccttgcagtgatgatgctgtgcagctgatctgcgagagcattgagaccctgcaggttccgagtgggcccccagacgtgctggctgctctggactgggccgtggggcagccccagcacagggcctaccctcggcagctgttcctgctcactgctgcctcacccatggccgccactacccaccgaaccctggagctcatgaggtggcacagggggacagccagatgcttctcctttgggctggggcccacctgccaccagctgctccagggtttatctgccctcagcagaggccaggcctacttcctgaggcctgggcagaggctgcagcccatgctggtacacggtcgcgggacgcctggacctggctcgatgaatttctgggctgcttgggccgactgtgcgggcttgtcccccggagtccaccctcccggggcgcgcggtggctctggggggacggccccccag

SEQ ID NO: 289424 - DNA, 1694 bp, Homo sapiens
aaactagctagtacgaggctgggtgttgaatcggccgaggctcaatagtcaaatgtgactagtggctaccacattggatcatgaagagagagaacatttccaagttttattagtgcagaagcaggtggaggaaaatgtgccagctaatgcttcctctgggtgttgtccagagtgctgaatttctgggcagccagggggctcttgctctgctatgggttgaagattcagcctgatcacttcttgtcaaagttggggagtctgagctggttctgggcctagcaaggcaatctactctgttaaagtcgatagagggagaagctggggagaacactgcaattttttctatgagccctctgtagagggtgggtggtgggggctccacagactgctccttggttccacaggccatgcccggaggtgctggcttcgagcccttcagacaagtaaggtcagctctgccccctcctgcttcacttgccctgtagctgtggatgctactactagggaggtcctgcctggggccctgcaggtgtgcagctcagagcccgctgagcccccaggaacccctcctgcctctcacagccatctagatgcagctcctctgcccactgttgtctactctaaaggacttcagagaggctctccagcaggcgcctgggactcggaccaaaatggcaactccaagcgtgctttgggggaccctgccactcccacggaaggtcctcgccgcccacctccccgtcctccctgtcggctcagcatgggccgccgtcacaaactctgtagccctgacccgggccaggccaacaacagtgaaggcagcgaccatgactacctgcccttggtgcggctgcaggaggcaccaggctccttccgcctggacgcgcccttctgcgccgctgtgcgcatctcgcaggagcgcctctgccgtgcctcgccctttgccgtgcaccgcgccagcctcagccccacctcggcctcattgccctgggcacttctgggccctggtgttggccagggtgacagtgccacggcctcctgcagcccgtcccccagctcgggctctgaggggccaggccaggtggacagtgggcggggctcagacaccgaggcctccgagggggcggaagggctgggcggcaccgacctgcggggccggacctgggccactgccgtagcactcgcctggctggagcaccgatgcgccgctgccttcgacgagtgggaactgacagcggccaaggctgattgctggctgcgggcccagcacttgcctgacggccttgacctggccgccctcaaggccgcagcccgagggctcttcctgctactgcgccactgggaccaaaacctgcagctacacctgctgtgctacagcccagcgaacgtgtgaaggctgccccctgctgcttgggctggcgccccacccaacacactcaagtcactgccgcccagggctggcctcttggtgctgggaaagtgtaggctggtgccagcctgtcccccactgcttcttactccctccctagagccctcttgcccccacaaaaagtgcctgcctgtgctctctccctctcctcccaccccactcacactcccctccatcctctgagctccctgcaacacagtggaagggtagagagccacagtccccaaatcctatgcaataaagtgcctcttagggactgcttgag

SEQ ID NO: 289425 - DNA, 472 bp, Homo sapiens
  misc_feature (406)..(406): n is a, c, g, or t
  misc_feature (411)..(411): n is a, c, g, or t
  misc_feature (436)..(436): n is a, c, g, or t
ttttttgagacagagtcttgctctgtcacccaggctggagtgcagtggcgtgatctcggctcactgcaagctctgcctcccgggttcacgcgattctcctgcctcagcctcccaatagctgggattacaggtgtgggccaccgtgcccggcctgcccattctttctttctgcccacctctccaattccttgagcattgcagtggatgtttaattttgagaatactaattagcttcagtaattacacaccttgaggcatttcaggatatttatagcattgtagtttcggtcttgatatgttgtagctttttggcttttgtgtctttttttttaagaaagctttgaattttgttcagagaagatttgtgttaatccatctaagtggaattcaggggtattagaagttngtttngtcagtgcccaagaatatcatattngtatttgttcatagcattttgagtaatccgtgaggg

SEQ ID NO: 289426 - DNA, 4357 bp, Homo sapiens
agcggagttcgcgccggcggtagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgtttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaagtcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaagttgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgagattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaa

SEQ ID NO: 289427 - DNA, 4450 bp, Homo sapiens
agcggagttcgcgccggcggtagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgtttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaagtcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaagttgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgagattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaaaaaaattaaaaactttagggggggcccgggacccattttgcctttagtgaagtcgatttaccctcgcttattggccttcttttttacaacttc

SEQ ID NO: 289428 - DNA, 4092 bp, Homo sapiens
taaaaaagtgtgtactgtttaatgtactctgttgttacaggaaaacaacagcatggtgttacggttggataactcaggacatcacaaaaatgttaacaacggtgtctacctaaacagtcatttctagtgcaagcagtaataatgatgaaaagttaaaatatattagatacattatagtacgtattaggcactgaagaaatactgtttggaaagaatgactagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgtttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaagtcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaagttgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgagattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaa

SEQ ID NO: 289429 - DNA, 3857 bp, Homo sapiens
agcggagttcgcgccggcggtagacgaggacgccaacagcagcggagaaacgtttctctttcctctcagtttgcgcacaccatggcggcccctgcccagcagactactcagcctggcggcgggaagcgcaaaggcaaggctcagtatgtgctggccaagcgcgctcggcgctgcgacgctggcgggccccgtcagctagagcccgggctacagggcatcctcatcacctgcaatatgaacgagcgcaagtgcgtggaggaggcctacagcctcctcaacgaatacggcgacgacatgtatgggccagaaaagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggatagagcctgagaaattggtgcatcatattctccaggatatgtacaaaaccaagaaaaagaagactcgagttattttgcgaatgttacccatctcaggcacatgcaaggcttttttagaagatatgaaaaaatatgcagaaacatttttggaaccctggtttaaagctccaaacaaagggacatttcagattgtgtacaaatctcgaaataacagtcatgtgaatagagaagaagttatcagagaattggcaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctctcctgtcccattgtgcattgtctgtgacatgcaacttacaaaactagcaattgtaacaataaatcacagccacttgacaagaaaggatattcattattttcaaatggcttttggactatcaaaaacagtaaggcttttgttcagaaatcacctttagtcaaaaggtttaagaagcaaattatttagtagcagaacttatctcaggaaaggaaaatatgcatggttggtgagaatctaataacattaaaatgctggggcaagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaagtcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaagttgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgagattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaa

SEQ ID NO: 289430 - DNA, 2362 bp, Homo sapiens
tgtcacaacattatatattggcctttgttctggcaggctcctagcaatagaaaaagttttctttgaatttcatcatttacaaatcttacaaatgctacagcatgacatttattagtgaaacctgttgactcatcatcctggatagagatgcagtacaaagttgaagagactttattctcaataagttgatttactgatgatatgtcatatgatgcaaaaaaggttttgtgtcattaactgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgttattaaaaaaaaaaaaagaaatcctgatgttgacattatagcacactgctttctccacagagatgctgatatcaaaaacttgaagatacagtgaagttctgaataatgttacaaaactggttacctgtatcaaagacccatttatgcaaaaatgttaaaaaaaaaaaaaacacccaaaacaaaaacctggacagacagcacataaacctcctgcaccatacagacatccagtggcttctcagaggaagcgttctctacaggatatttgaattgaaaggtgaattgccagagtacttacaataaaacagccagcttttgctgagtgctttggaaatgaaaaatgactacagaaagtagcctattttgcagacgtttttcatcacatgaacaaatggacaagtctctgaaaggttctggggaaaaaaatttttcttaaagcgacaagactcttagatctaaaaggaaactgacttgccaccttgccagaggaattcttgaaatgtttctgcagccacttggccttgaaaataaagggtgcaactctcaagtcttgttctaacccggctggaggaaccacaagacccaatgaaatagcattttctctccttttcccagcactagtatataacctatgaggaacccttgtctctgaatctgctcagcttgaaattttgtctctgaaggaagagaatgaactcagccctagtctgacagtcctagatttctgtgaaataagagtattcttcaacttagtgctcacactcacataccatgagggttctctgcaggggtttaggggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaagttgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgagattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaa

SEQ ID NO: 289431 - DNA, 639 bp, Homo sapiens
gcggccgcctactactactaaattcgcggccgcgtcgacgatcaattggaaaacccaggtgacccaattggccatatgcctacagagcatacaactctgtggaactaaattgtttttactttgtgaaagctgctattttacggaaagattttgattatacagtttgtttttaagttgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgagattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaa

SEQ ID NO: 289432 - DNA, 3063 bp, Homo sapiens
ttcatatagtttcagttatcagagtattagaccagactttatttgcaatttgttcaacagagagattttattttgatacagatattaagcataaagcatagtaagttttatataattctatgagttcattaaacaatattatgaaattttcattatgttcgtggggagtctttttaactgtttctacctcatatatgaggtctcttctgtattttactttgcatactagcatgtgattgcctgccttagaactatgtagaggaggggaaatcgatattaccttttaagaaatttttgattttatgaagtgttttcattaatacttttttaatgtttgagaagtaaaggggaaagggtggcaaattacataggttgcaacacagagtagaagtcacatagtactatttacagatctgtcctgttttaagatttgagaattgtgaacaggatggagcaatggttctcaaacttcagccagtatcagaattgcctcgaggtcttgttaaaattcagatagctggacccacccccagcatttctgattttggtctggagcctgatgatttgcatttccaacaagtttccaggcgatgctgatgctgccagtccaggaaccacactttgaaaatcactgggtctgattctcgcagtttgaaagtctcagagaccttcagagtctgaacgtcttttcaaccatgtatttatttactcagtgtaaaaaactgatctctggagacatttttataaatctggtgccatgactggaacatttgtggagaaaggtctccatggagcgacaggccctttggattggccaccacccctcctcactctcacccctgctggggtctgcactgctcttccgcagtagggtgaaggagctctttggttttagggtgagtttgcttttgtgtacgctgctgcctggacatcagtctggaagctgtgcatttgtttggtgtgcttagggtcaatcttgatccacatgcatggaagtgagaatcctggaaagaagccatcagaatgccatgagagtgcacctagcatgtatcgaggcactaagtgcaggagtccctgtcctaagatggcagtgacatggagcatcgaaaaccacagataatccttaaataataaaataatagttttgtttttttttcttcggggcagagtctcgctctgttgccctggctggagtacagtggcatgatctcggctcactgcaacctccgcctcccggcttcaagtgattctcctgcctcagcctcccaagtagttgggactacaggcatgcgccaccacgcccagctaatttttgtattttttagtagagacggggtttcaccgtgttggccaggatggtctccatctcttgacctcatgatctgcccgcctcgggctcccaaagtgttgggattacaggcatgagccactgcgcctggcaaatgttttagtttttatggttattattattttttttttttgtggggggagggtggtgagggcaaaggatttgtttttcaaattatgtgtttctcaggttaacaaagttattttagattctctgccatgccagcaggtgttagagagagcctgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcctgttattagtgacacaggatttttttttaatgcttcatacatatagttcttatctaaacttgttcagctaacttcatagatcagttacttagcaaattcatactgagtcttattttgggaagtcttcctgagggaagctgtacaaaactgaggtggtcaggttcatctcttcaaagtaccagttatacagccatctaaataggcataacttatggcaaaattataacaattttttttctttgcagtaaacgatacctcatctaagaggctctaatacctaaagagtttatccttaaaagtaaaagtgactttgtaccataaaataaccccaaagccactctctagggtttttattttcttctttctttgtctttatcttttctaacttagttttggaattacgttagctactttggttccatagaacaagttttcaacttggggtctacagttcctacagtgtgctcattgtctcagtgaagttcttttgttttcaaagattcatggtaacaaaatgtattttactgctacaactaaaatgtatttataataaaatgcctttttaataatttggagatg

SEQ ID NO: 289433 - DNA, 1329 bp, Homo sapiens
aagcttgcggccgctcccacttaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcctgttattagtgacacaggatttttttttaatgcttcatacatatagttcttatctaaacttgttcagctaacttcatagatcagttacttagcaaattcatactgagtcttattttgggaagtcttcctgagggaagctgtacaaaactgaggtggtcaggttcatctcttcaaagtaccagttatacagccatctaaataggcataacttatggcaaaattataacaattttttttctttgcagtaaacgatacctcatctaagaggctctaatacctaaagagtttatccttaaaagtaaaagtgactttgtaccataaaataaccccaaagccactctctagggtttttattttcttctttctttgtctttatcttttctaacttagttttggaattacgttagctactttggttccatagaacaagttttcaacttggggtctacagttcctacagtgtgctcattgtctcagtgaagttcttttgttttcaaagattcatggtaacaaaatgtattttactgctacaactaaaatgtatttataataaaatgcctttttaataatttggagatg

SEQ ID NO: 289434 - DNA, 3104 bp, Homo sapiens
ttcatatagtttcagttatcagagtattagaccagactttatttgcaatttgttcaacagagagattttattttgatacagatattaagcataaagcatagtaagttttatataattctatgagttcattaaacaatattatgaaattttcattatgttcgtggggagtctttttaactgtttctacctcatatatgaggtctcttctgtattttactttgcatactagcatgtgattgcctgccttagaactatgtagaggaggggaaatcgatattaccttttaagaaatttttgattttatgaagtgttttcattaatacttttttaatgtttgagaagtaaaggggaaagggtggcaaattacataggttgcaacacagagtagaagtcacatagtactatttacagatctgtcctgttttaagatttgagaattgtgaacaggatggagcaatggttctcaaacttcagccagtatcagaattgcctcgaggtcttgttaaaattcagatagctggacccacccccagcatttctgattttggtctggagcctgatgatttgcatttccaacaagtttccaggcgatgctgatgctgccagtccaggaaccacactttgaaaatcactgggtctgattctcgcagtttgaaagtctcagagaccttcagagtctgaacgtcttttcaaccatgtatttatttactcagtgtaaaaaactgatctctggagacatttttataaatctggtgccatgactggaacatttgtggagaaaggtctccatggagcgacaggccctttggattggccaccacccctcctcactctcacccctgctggggtctgcactgctcttccgcagtagggtgaaggagctctttggttttagggtgagtttgcttttgtgtacgctgctgcctggacatcagtctggaagctgtgcatttgtttggtgtgcttagggtcaatcttgatccacatgcatggaagtgagaatcctggaaagaagccatcagaatgccatgagagtgcacctagcatgtatcgaggcactaagtgcaggagtccctgtcctaagatggcagtgacatggagcatcgaaaaccacagataatccttaaataataaaataatagttttgtttttttttcttcggggcagagtctcgctctgttgccctggctggagtacagtggcatgatctcggctcactgcaacctccgcctcccggcttcaagtgattctcctgcctcagcctcccaagtagttgggactacaggcatgcgccaccacgcccagctaatttttgtattttttagtagagacggggtttcaccgtgttggccaggatggtctccatctcttgacctcatgatctgcccgcctcgggctcccaaagtgttgggattacaggcatgagccactgcgcctggcaaatgttttagtttttatggttattattattttttttttttgtggggggagggtggtgagggcaaaggatttgtttttcaaattatgtgtttctcaggttaacaaagttattttagattctctgccatgccagcaggtgttagagagagcctgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggactgcatcttggggggtactgggctctgcttctggtttttagtttgcctttgaatttactgagctactagaaagacaaaaaaaagctatttttatggtaatagaatacagaatgacttaggtgtaaaagtacacgtgaagaccatcgtagaatatacagctttggagttttcttaagacacagtccttcctactgaaaaggcttgctcacctttggagaggattgtttatattttcagcctgggttcctttatgcagtcccaacttagaggggagcttcggtttatttacactttgctttgcacgataacttgtatgcgaagacctctttatatctttcagtaggtcagagggctctttgtcctggttgaagtcccaaagtgtcagtgcagctgagaatgtttctcagcctccccctttacagaggaagggtcctggattttcataaatccagaccatgcctgcttcctataaatccatgtatatgacattgtactgtatctgatttctgtgccagtcatctgacctgattctttaaaccccataaaggtactggctatatgtagtagttgtatcctaggtaaatatggtgattaaaatacttctcttctaaattataaagataatgagttttgcattttattaaagggtcctgttattagtgacacaggatttttttttaatgcttcatacatatagttcttatctaaacttgttcagctaacttcatagatcagttacttagcaaattcatactgagtcttattttgggaagtcttcctgagggaagctgtacaaaactgaggtggtcaggttcatctcttcaaagtaccagttatacagccatctaaataggcataacttatggcaaaattataacaattttttttctttgcagtaaacgatacctcatctaagaggctctaatacctaaagagtttatccttaaaagtaaaagtgactttgtaccataaaataaccccaaagccactctctagggtttttattttcttctttctttgtctttatcttttctaacttagttttggaattacgttagctactttggttccatagaacaagttttcaacttggggtctacagttcctacagtgtgctcattgtctcacggaaagtctcaggggcccaagatccgggtaaccaagtatcttacgggaacagtaagagggtttcacacaaacgggccttggagtagacagacaactcgggggggccgtaccacatcgccgaagcgtatacagcacgggcgggt

SEQ ID NO: 289435 - DNA, 411 bp, Homo sapiens
ccacctcagcttcctgagtagtcgaactacaggtgcacgccaccacacccagctaatttttgtatgttttgtagagacagggtttcgccatgttgcccaggctggtctcgaactcctgggctcaagctgtcctctcatgttggtttcccaaagtgttggaattgtaggcatgagccaccacactcagcctgcgttaatactcttaattatagaaacaatccttaattaataaacaagtcctttcattggaaaaagaactaatacattttgttctctcagtcaaaattctgtttttgtggttagagtaataaaatggtaacacctagggtctgccacgatcatggttctcactctggattcattccctaccacatccttatttccctcctcttccccattccctcactcacc

SEQ ID NO: 289436 - DNA, 2070 bp, Homo sapiens
ctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttgggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgc

SEQ ID NO: 289437 - DNA, 1989 bp, Homo sapiens
ctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttgggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgc

SEQ ID NO: 289438 - DNA, 567 bp, Homo sapiens
aggccatggtcatggtcagcgtggagaggatgaagcctgagcaggcaggatcgggggtctagaggggaaggaggtggaagttgagatcacagacctgtggccaggtggcctgggaagggtttgacgagtgtcggcccaaagagcttggaagggattttgctgctgtgggtgagcactgcctctccccttagggacaacagccacctcttctctccccatttgcctttcccttctgtagatatgaaacacaggcctccttgtcaggcccctacttaacctccgtgatggggaaagcggccggagaaagggagttctggcagcttctccgagaccccaacaccccactgttgcaaggtgagtcatggcctgacactctggatgtgtcccctaccccaagcttactcagccaagaggcttcatcaactcaccccagctttccctagcaccctcctgggccacaccttcacaaaatcactgatgctcaaagttggatataatatattgaactgaagccttagaatttttatgcaagttactgtggaaattctaggaaaccagacagattac

SEQ ID NO: 289439 - DNA, 3343 bp, Homo sapiens
ctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttgggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgctacagtggcctggtgcctcatactcctcaggtgcaggggcagggacaagagaagggggaagtaaccccatcagggaggagtggagggtgcctgagccgccatgtgggcattgggggagtgatgggaatgccagcagtgatgacattgactactgactgagcacccactactatgactgagcactcactcgctagatactatcttgaactgctctgtgaggttgttgatattttcatttttatctgtgctttacaaatcaggaaactgggaggccgggcatggtggctcacgcctgtaatcccagcactttaggaggccaaggcaggtggatcacaaggtcaggagtttgagatcagcctggccaacatggtgaaactccatctttactaaaaatacaaaaaattagccaggcatggtgttgcatgcctgcatgcctgtaatcccagttacttgggaagctgaggcaggagaattgcttgaaccctggaggcggaggttgtagtgagccgagatcacgccattgcactccagcttgggcaagaagagaaacactctcaaaaaaaaaaaaaaatcaggaaactggtgctcaaaaaggaaaagtgactcaccaaggtcacagactaggcagtgatgctgggggaacctggctcaggggacacagacctggcctggggcagccttgcagctcctccactaaaatactgaaaatgaggggcttcgatgatggttataatcgtatggcagagccccaactcaactggagccctgggacccagaagctagggtctcactccctgcttttccacaaggcaccattagggcatcaccccaggcctcggcagccacgacgcagggatcctgcctctcattggttgggggcttaggggctctgggctgccctcttgaagagggggttcagcccagcgaggcaccccctatgctgcaccccaccaaggttaggaagaggtcctgtcctcagtggggccctctgatgaacagcccatcaggtctgcgtccacatgccttggaagagatggtgacatactcaaagtccttgaagccgcatattaaaccacctagagcaccatcttcaaacatttagggtctgagaagataggggaagtaagcaatttaaaacatttctttatattgggccaggtgcaatggctcacgtctgtaatcccagcgctttgggaggacgaggatcacctgaggtcaggagttcaagatcagcctggccaacatggagaaaccccatctctactaaaaatac

SEQ ID NO: 289440 - DNA, 2354 bp, Homo sapiens
ctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttgggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgctacagtggcctggtgcctcatactcctcaggtgcaggggcagggacaagagaagggggaagtaaccccatcagggaggagtggagggtgcctgagccgccatgtgggcattgggggagtgatgggaatgccagcagtgatgacattgactactgactgagcacccactactatgactgagcgggagaaactggctctgagcgggagaaactggctctgagcgggagaaactggctctgagcgggagaaactggctctgagcgggagaaactggctctgagcggg

SEQ ID NO: 289441 - DNA, 1682 bp, Homo sapiens
ctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttgggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtgagtcatggcctgacactctggatgtgtcccctaccccaagcttactcagccaagaggcttcatcaactcaccccagctttccctagcaccctcctgggccacaccttcacaaaatcactgatgctcaaagttggatataatatattgaactgaagccttagaatttttatgcaagttactgtggaaattctaggaaaccagacagattac

SEQ ID NO: 289442 - DNA, 414 bp, Homo sapiens
ggaagtctcaggaatgggtaagtgctcctgctcccacacagtctacagacctgggtgcaatggtgagaaagacctcagtaaagcaaaggaattacgaaagggagaggattcggaatcacaccgtcagttctcctggttctcaacccttcagagacagactgaattacaccaccagctttcttggttctccaggatgcagatggcattaacatgagactcctttacctccatgactgtggaggcagcagctgaggctgtggtgggagaagaatgacaagaactgagcgtgggccacgggctcttaccttcagcaacttcatcagctcttccagctggaccatcagctcccgcctgctctcctgcagggccgacatcctctgctccagttcatccttcctttgcctatccaagacg

SEQ ID NO: 289443 - DNA, 1291 bp, Homo sapiens
atagcccacaccttgacagtacattcagtcactggatgattttgtattgaagtctgtaagttcaagaactaaaacaatccaaaacggctactacaggtgaagttgagagcaatggcccaacctcagctgtatctaccagaaccctttaagattgcctacagaaaagttggacagtgccgaagattccagcaactcaagaagaaaaatggctcattcaaaaggaaggggatagaaagatggcatagagctgtgtctaccaacttactaaaacaaaatgtattggtccctaaagaggaatcatccagtgatagtgacatgggatttcatgaaagccagcaaaatcagaaaagtaatttgaagacgaaagtgaagactgcttttgggaggatgctgtcctacaagtatagaagcaagccagcatgtgccagccaagagggctccactgaccataaagaagccctcctgtcaaacacgcagagccttctccctaggattgtcaaggagttttcatctcccaagttatttacagcaaaaatgagaaagctctcagagaatgcgactatacaacttgatgttgtagaggcagagacagaggagataacccagggaaacacactccttcgggccaggagaaccaccaagcggttatctgtgacatctcttccttcaggactgcaaaaggggccatattcaccaaaaaagagaccacactttccagcacttaaaaaaaagaagcgtggcatggaaaacatccttcgaaaatcagatttgacagtaggaaagcttcaaatgcaggtggatgacctcatagaaacagtgactgataaatccatgaagctactggcccaaagacatgctgagcttcaacagtgtgagtttctgggggatgaaattcttcagtcttctaaacagttccagaggatatccaagagaaccatgaggaagtataaattaaaaaatatgaccacaaaaggacctggagacagctgacctgagactccttgaggaacacaggaaaaggtcttcagacaataacttaaccaattaccaatcagaaaatcgactccacctatgagctggaagtccttcccaccccccaccttcaagctgtcctgcttttctgtactgaaccaatatacatcttacgtgtattcattgatgtctgcctgtaacttctgtccccctaaaatgcataaaatcagctgtaattcaaccaccttcggcacatctcaggacctcctgatgctgtggcatgtctttaaccttggcaaaataaactcctaaattgatt

SEQ ID NO: 289444 - DNA, 1007 bp, Homo sapiens
atagcccacaccttgacagtacattcagtcactggatgattttgtattgaagtctgtaagttcaagaactaaaacaatccaaaacggctactacaggtgaagttgagagcaatggcccaacctcagctgtatctaccagaaccctttaagattgcctacagaaaagttggacagtgccgaagattccagcaactcaagaagaaaaatggctcattcaaaaggaaggggatagaaagatggcatagagctgtgtctaccaacttactaaaacaaaatgtattggtccctaaagaggaatcatccagtgatagtgacatgggatttcatgaaagccagcaaaatcagaaaagtaatttgaagacgaaagtgaagactgcttttgggaggatgctgtcctacaagtatagaagcaagccagcatgtgccagccaagagggctccactgaccataaagaagccctcctgtcaaacacgcagagccttctccctaggattgtcaaggagttttcatctcccaagttatttacagcaaaaatgagaaagctctcagagaatgcgactatacaacttgatgttgtagaggcagagacagaggagataacccagggaaacacactccttcgggccaggagaaccaccaagcggttatctgtgacatctcttccttcaggactgcaaaaggggccatattcaccaaaaaagagaccacactttccagcacttaaaaaaaagaagcgtggcatggaaaacatccttcgaaaatcagatttgacagtaggaaagcttcaaatgcaggtggatgacctcatagaaacagtgactgataaatccatgaagctactggcccaaagacatgctgagcttcaacagtgctggccgtggtggctcacgcctgtaatctcagcactttgggaggccgagcgagtggatcacttgatgtctggagttcaaaaccagcctggccaacatggtgaaaccctgtctctactaaaaatacaaaaattatc

SEQ ID NO: 289445 - DNA, 447 bp, Homo sapiens
aacaagcaacaaaatcaaaggtaaagccatctgagagctggcaatgcaaagggacctaaattaatcaaaatgcagacaggacgagcccttccttggggaaggagcccacagctttcaccctggtgcgaggcagcagggcgggatgccctgcgtgaggggaaatgagtggaagttcatgaccgtgtggggactggcgtgacagatgaggactccagggagccccagcacagcccgcctctgccccctgccaactccctcacacgggcttcatggaaggttgggcgcgagggagtgaggtgcagagaaacctcctgaggtacagaagtgggggcgagactggagagcggaggtgggaggatcacttgagcccaggagtttgaggctgcagtgagcaatgatggtgccactgcactctagcctgggtgacagagtaaaattctgtctcta

SEQ ID NO: 289446 - DNA, 532 bp, Homo sapiens
tgaattatcttaaaatactcagcatcaagtggaaatacatgcatgaatccagatcgtagaacattttataaaagaactggcctggacacagcgcaatgtcactgtcataaaagagtctcccaaaaaagaagtgagactttctaggtaaaaagaggtaaaaaggcaggtcataggcaacactggtgctttcaacggacgctgaattttttaaaagcagctaaaaaggatgttttggggagagctggggagaattaaaatactaatagatgtctagaaatgcagatgatttatttttcacagattggatatgaccttgacaatgacatgcatatttgtcaatgtttccagattttccggatggcctgtggactgtctaccttagtcagtattatcacatcaatgatgaatttctaagctctctgtaggtctgacgatttccaaaataagctggggaaaaaggtgttaagaaaatgcaggcggcatccacttctagtcagaaggtagaaaagttacaaaagactgtctcgcccta

SEQ ID NO: 289447 - DNA, 762 bp, Homo sapiens
tgaattatcttaaaatactcagcatcaagtggaaatacatgcatgaatccagatcgtagaacattttataaaagaactggcctggacacagcgcaatgtcactgtcataaaagagtctcccaaaaaagaagtgagactttctaggtaaaaagaggtaaaaaggcaggtcataggcaacactggtgctttcaacggacgctgaattttttaaaagcagctaaaaaggatgttttggggagagctggggagaattaaaatactaatagatgtctagaaatgcagatgatttatttttcacagattggatatgaccttgacaatgacatgcatatttgtcaatgtttccagattttccggatggcctgtggactgtctaccttagtcagtattatcacatcaatgatgaatttctaaggtaggacaattcaactgtggtcacacaagaggacgtctttgtttttgggagatccaggttatgatggctgcaacttactttcaaatgggttaggggaaaaaaaagaaaaaagtatacacatacaaatgcataaataagtagacagacacataaagttaatgcattaaaatgttcacaagtggtgaatctgtgtgaagggtggacagatgttaactgtactgttctttcagctctctgtaggtctgacgatttccaaaataagctggggaaaaaggtgttaagaaaatgcaggcggcatccacttctagtcagaaggtagaaaagttacaaaagactgtctcgcccta

SEQ ID NO: 289448 - DNA, 714 bp, Homo sapiens
tatacacatacaaatgcataaataagtagacagacacataaagttaatgcattaaaatgttcacaagtggtgaatctgtgtgaagggtggacagatgttaactgtactgttctttcagctctctgtaggtctgacgatttccaaaataagctggggaaaaaggtgttaagaaaatgcaggcggcatccacttctagtcagaaggtagaaaagttacaaaagactgtctcgccctaaagatgaaaacaagccaaacaagcaacaaaatcaaaggtaaagccatctgagagctggcaatgcaaagggacctaaattaatcaaaatgcagacaggacgagcccttccttggggaaggagcccacagctttcaccctggtgcgaggcagcagggcgggatgccctgcgtgaggggaaatgagtggaagttcatgaccgtgtggggactggcgtgacagatgaggactccagggagccccagcacagcccgcctctgccccctgccaactccctcacacgggcttcatggaaggttgggcgcgagggagtgaggtgcagagaaacctcctgaggtacagaagtgggggcgagactggagagcggagagcaccccagtggccccacagtctggcggcagggctgaataccagaggcctcccacagttccaaaagctggcgactttaaaacataaagacatccctggaattctgccagggc

SEQ ID NO: 289449 - DNA, 386 bp, Homo sapiens
agctccccctgtattctctcaccatgtcattggcgtggagaagcaggaacctaaacatgggaagtgaacatcaaaatatgtcatgatcacagtgtgcttcaagatacatatctagactataaagaaaagcacagggattatgaacataaccttcagaagagtggtcacctctgttgcgaagcaaggggactggatcagagaagaaattccagcagtcctgtagcttccacaggactagaaatgtttcatactgcatgaggtcatgggtttatggatgttatttaattgttatgcttcataacttagatgcacatcccatgttgagaatatctcctatagaaacaaagcacttgtatttaagaatgtgtaaaaaaacaaagggaaaa

SEQ ID NO: 289450 - DNA, 779 bp, Homo sapiens
cgcggccgcttctgcattcccccagcaacggcgctctgctagagagctgccgtaagtcacgctactgccgcaagcctctgccgtcgctaagcacgtctgtaggttcaggctaaggttttccgtcagaaggccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaaca

SEQ ID NO: 289451 - DNA, 1887 bp, Homo sapiens
cgcggccgcttctgcattcccccagcaacggcgctctgctagagagctgccgtaagtcacgctactgccgcaagcctctgccgtcgctaagcacgtctgtaggttcaggctaaggttttccgtcagaaggccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaacagttgagctctttacttttagtaagaccgacagaaatgtagtcagtaaagcacatgtagtgataggctatcagttatgtctgatacataagacagaataatatttcacaattagaaagtaccttagagatcatcttgctcacagtagatcattaatatcaataattaaagatgaagcttaatccaccatggtcatcagtcaggtggggcttattctaaatgcttaatgtgtcttaagctcatttccttgttcatatttgggttgctacttggctaaatcctttcaccttagtaccctaagccagtttcctggcttgatactatttgataatgctctgctcaggaatgattatattgggtgagaaatggagccctggggttgtgtgttttggaacagtattcaagatcaaagaaagttcttagtccatggttaatctgcaaggcatttaagccacttccatagaggagcccagattgttggttaaatatattgataatgaagtcaaagctgtggttccaaccccgatttttccaagaaaaatgacgtctggttatcactttgtacacgaagtgctaaccaggtatcttgataaattgtttacagtaggtattgagaaacctcatgtggattttttaatttggttagatgtgggatcacttttgaggatgaggccagctctctatgttctctttttcttcttgcagtagtccccagaaactcagtctgctttccttttctctcgatggctgtcagcacccatctaatgaaattgtcttctccaaaagactgactttaggatcagatacaattttcaccagtgttttttgtctaccttgctgcttctgaaaatatacatataagccttttaaaatgaaaagtttattaacttataattaaatagacgtagatgcatatgtgttgcattaggtgaaaagaaaaactgccagggagttataagaggaaatggaaagatcttgaacatgtggggcattgagtagagactcagaaaggttgtactttcataagagatccaaactggagctagactaaaggctaatgtataccaattttaagaaagcttaaaaataagccttgagagactcaagatg

SEQ ID NO: 289452 - DNA, 901 bp, Homo sapiens
cgcggccgcttctgcattcccccagcaacggcgctctgctagagagctgccgtaagtcacgctactgccgcaagcctctgccgtcgctaagcacgtctgtaggttcaggctaaggttttccgtcagaaggccgcgcaagtgcacttgcgtgtcaccgttaccgtagcgactgggcttctggactgtatatcctagctgccttgtcaacatcttcgagcatcggcagctccggaggccggggtaactggcagcaggtaggaaactatgtgaaagaatctcctgatgtcataatttccgggtgtcaccggaacatttgatcatcattcctttggcaattccagccttctgtggaaaggccagtagaaagcattgatttattcacctctacaggaatcagactcagcctcttttggttttcagtgaagtatgccttttcaatttggaacccagccaaggaggtttccagtggaaggaggagattcttcaattgagctggaacctgggctgagctccagtgctgcctgtaatgggaaggagatgtcaccaaccaggcaactccggaggtgccctggaagtcattgcctgacaataactgatgttcccgtcactgtttatgcaacaacgagaaagccacctgcacaaagcagcaaggaaatgcatcctaaatagcaccattaagtcttttgtcaaggtctgactaggtcaagggtaatggaccagtatcatctggtgatctggtaaacaaataaaagtggtggcacctttagatgatgacaacattataacttatagacttttggtatgacctagcatatttgttttaattatctttcttaatatagttaggctttatattatgtttggtaacatttggctaaagtatattttatactatattata

SEQ ID NO: 289453 - DNA, 365 bp, Homo sapiens
agcgactgggcttctggactgtatatcctagctgccttgtcaacatcttcgagcatcggcagctccggaggccggggtaactggcaggtaactaggctttggagtggtattttaaaatatgtgtcgttaagctgttcgtgggctatcagaggtttaatttttgttcacagcctcaacacccggggcggtggatcagtccgtttattcagattccacgggacgctgcgttggcatctctgttcaacaagccctttattctaatagaaaatgaacaatggcgttgagcaaagagaaaccccagagaaatagtcatgtcagggcacaattgaaactagatggttatacgctttgacaaaaatggcaaa

SEQ ID NO: 289454 - DNA, 2758 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289455 - DNA, 720 bp, Homo sapiens
tcattttctcttgatttggaagtggctgttcttactgccacttttctaaatgtttttgtggattcgagaccattacccaccatccagaccaatctgaacccttccaatcacctgtggcttggcaaaacaaaacaaacaaaaagcccaaaattgcctgctactggagtaagtccttgtcctttctctttttttgtagctgagccgagctacagtacatgaccctgagactggaaaattgaccacagcacagtacagagtatctaagaggtaagggagtaatggagagaactttagtcatatttggaccatttctttcttgggaatctaattttctgaaaactcatgatatagtttctaagacctaggtggttaggcatagatgtttgataatatctgtgctggagttttcatgacggactaataaacatggttatggggcagttaataggggttttccaaagtaacattaacttacataatgtctgttgaggctccccaaactttgataagtgaaatgtgttctcatattgaactaagagaagttcccaaattcccttcattaaacaaggcctcttttggactctgcagtaaagcaggggtttaaaaatctcagggtcacctagtagctgcaggtattgcgtaagtaagtgcctttataacaaagcctttgcaagttccttgcttttaacagtgtttaaagataatcttattaggttatta

SEQ ID NO: 289456 - DNA, 278 bp, Homo sapiens
aagtttaaaaatgtacaagtatttaatcagaatgccaatatttaccacccccgctgtagcaggaataagaggcaaggtattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289457 - DNA, 260 bp, Homo sapiens
tactactactaaattcgcggccgcgtcgacaaaaattcgctgactcaaaagttggcagtaggaagaacagagttacgcttctgagctctgtcttccaaaaattagttgtaaacttagttgccttttactttgccagagagatttaaaaacagttttatctcagtgagaggtttgaaaaatgaatttaaggagtctactattttttttcaaaatatttaaataacttctagatctgagaaagtttctgtgaaacccagtgc

SEQ ID NO: 289458 - DNA, 2686 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289459 - DNA, 2704 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaagtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289460 - DNA, 2717 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacaacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgagccgagctacagtacatgaccctgagactggaaaattgaccacagcacagtacagagtatctaagagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289461 - DNA, 2735 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacaacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagctgagccgagctacagtacatgaccctgagactggaaaattgaccacagcacagtacagagtatctaagagtgcctggctctctggctatgatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289462 - DNA, 1666 bp, Homo sapiens
tcgagctcggtaccgtgctactccactaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289463 - DNA, 1293 bp, Homo sapiens
  misc_feature (45)..(45): n is a, c, g, or t
atttcggaacgagggggaaatagaattgctacatggctgttttanatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289464 - DNA, 952 bp, Homo sapiens
acgatccgaatcgagccggtacccgatgagtaatcttggtccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289465 - DNA, 2681 bp, Homo sapiens
  misc_feature (2598)..(2598): n is a, c, g, or t
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttcgattttttttttttttttaatggaaagtcctgcataacaacactgggccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactgantaaagacagctcaggatgaggatgatttttaagctttctagaagcaaatgttgtcttcagatctgaatggtgtgacacatgac

SEQ ID NO: 289466 - DNA, 2625 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacactccatgattgattcagtcatgaacctcatcccatgtttcatctgtggacaattgcttactttgtgggttcttttaaaagtaacacgaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgagttaaaatatttccttcttaactaaaatgctcaccacttagcctgtttttttatcccttttttaaaatgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289467 - DNA, 1968 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatgggtatccaataaatggctccatgaacgtggacaagaatttcgaagaccttgtacgttgtcagaattggaatgacaaacaggcttccctttttctcctattgttgtactcttatgtgtctgatatacacatttcctagtcttaactttcaggagtttacaattgactaacacattgattttttttaaaagtctttttcttagaaagccaaaatgtttgtttttttaagattctgaaatgtgttgtgacaacaatgacctatttatgatcttaaatcttttttaaaaaaaaaattg

SEQ ID NO: 289468 - DNA, 1843 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagtgcctggctctctggctatgaaaatcctgtggtgtctcgaattaatatgagaatacaagatctaacaggactagatgtttccacagcagaggaattacaggtagcaaattatggagttggaggacagtatgaaccccattttgactttgcacggaaagatgagccagatgctttcaaagagctggggacaggaaatagaattgctacatggctgttttatatgagtgatgtgtctgcaggaggagccactgtttttcctgaagttggagctagtgtttggcccaaaaaaggaactgctgttttctggtataatctgtttgccagtggagaaggagattatagtacacggcatgcagcctgtccagtgctagttggcaacaaatggggtaaatatttcatatattctgcgaagataatgtaatttttgtttcttattttggaactattatctgtgtcttaaaaacaaaagcccccatgtttgcttaatatgattttaacattgtacaggattcagccaaacaagtgcctaatcataatacaaatttgaaatcag

SEQ ID NO: 289469 - DNA, 1814 bp, Homo sapiens
cctctgctgcccagtcgcgccgccagcgggctgagggtaggaagtagccgctccgagtggaggcgactgggggctgaagagcgcgccgccctctcgtcccactttccaggtgtgtgatcctgtaaaattaaatcttccaagatgatctggtatatattaattataggaattctgcttccccagtctttggctcatccaggcttttttacttcaattggtcagatgactgatttgatccatactgagaaagatctggtgacttctctgaaagattatattaaggcagaagaggacaagttagaacaaataaaaaaatgggcagagaagttagatcggctaactagtacagcgacaaaagatccagaaggatttgttgggcatccagtaaatgcattcaaattaatgaaacgtctgaatactgagtggagtgagttggagaatctggtccttaaggatatgtcagatggctttatctctaacctaaccattcagagacagtactttcctaatgatgaagatcaggttggggcagccaaagctctgttacgtctccaggatacctacaatttggatacagataccatctcaaagggtaatcttccaggagtgaaacacaaatcttttctaacggctgaggactgctttgagttgggcaaagtggcctatacagaagcagattattaccatacggaactgtggatggaacaagccctaaggcaactggatgaaggcgagatttctaccatagataaagtctctgttctagattatttgagctatgcggtatatcagcagggagacctggataaggcacttttgctcacaaagaagcttcttgaactagatcctgaacatcagagagctaatggtaacttaaaatattttgagtatataatggctaaagaaaaagatgtcaataagtctgcttcagatgaccaatctgatcagaaaactacaccaaagaaaaaaggggttgctgtggattacctgccagagagacagaagtacgaaatgctgtgccgtggggagggtatcaaaatgacccctcggagacagaaaaaactcttttgccgctaccatgatggaaaccgtaatcctaaatttattctggctccagctaaacaggaggatgaatgggacaagcctcgtattattcgcttccatgatattatttctgatgcagaaattgaaatcgtcaaagacctagcaaaaccaaggctgaggcgagccaccatttcaaacccaataacaggagacttggagacggtacattacagaattagctaaaagctgagccgagctacagtacatgaccctgagactggaaaattgaccacagcacagtacagagtatctaagaggtaagggagtaatggagagaactttagtcatatttggaccatttctttcttgggaatctaattttctgaaaactcatgatatagtttctaagacctaggtggttaggcatagatgtttgataatatctgtgctggagttttcatgacggactaataaacatggttatggggcagttaataggggttttccaaagtaacattaacttacataatgtctgttgaggctccccaaactttgataagtgaaatgtgttctcatattgaactaagagaagttcccaaattcccttcattaaacaaggcctcttttggactctgcagtaaagcaggggtttaaaaatctcagggtcacctagtagctgcaggtattgcgtaagtaagtgcctttataacaaagcctttgcaagttccttgcttttaacagtgtttaaagataatcttattaggttatta

SEQ ID NO: 289470 - DNA, 602 bp, Homo sapiens
gctttatctctaacctaaccattcagagacagtactttcctaatgatgaagatcaggttggggcagccaaagctctgttacgtctccaggatacctacaatttggatacagataccatctcaaagggtaatcttccaggtaagatcattcttccattctataaaatacctatcacctagcttctctgttgagtccattaacacaatgttagtataaaaaagacttgcattttaagattttaaattgtagtttgtttcatagccttcgaagactaaagaatcaccttccctttctcttagggcttaatagttacgggtatgcttctagcttctagcttgttactctgaaagcttgtattgatagagactaacttaagtagggaattttagtgtgtaaggaaaagaaactatcatttcaccaaatgtttttattcagaacacctaatactatttgaaagctttgtatgtaaagctataagggattgatagtcaaagtttatatgttaaataattaaaagccaagatgttttgggtatccacatatgtttaaagtgttccatagtatggaacatcctactttctgacctatttttggcaaagtcc

SEQ ID NO: 289471 - DNA, 685 bp, Homo sapiens
ggagtagtagtcttcacctatgcagttttctcatattcataaatgctgcggtgattcatatcctccttcatggtgattacgttggcatttgttcatacatcttgtaaaataacattgtcattatgtagtaatctgtattcctcctgtttgagttttttatttaaaaaaattcgctgactcaaaagttggcagtaggaagaacagagttacgcttctgagctctgtcttccaaaaattagttgtaaacttagttgccttttactttgccagagagatttaaaaacagttttatctcagtgagaggtttgaaaaatgaatttaaggagtctactattttttttcaaaatatttaaataacttctagatctgagaaagtttctgtgaaacccagtgctataaatcatttacatacagcttcaaatgattttttgtttaaaaaaagtgaaaggacaataaatctacaacaaaaatctgtcaactcattttctcttgatttggaagtggctgttcttactgccacttttctaaatgtttttgtggattcgagaccattacccaccatccagaccaatctgaacccttccaatcacctgtggcttggcaaaacaaaacaaacaaaaagcccaaaattgcctgctactggagtaagtccttgtcctttctctttttttgtagctgagccgag

SEQ ID NO: 289472 - DNA, 723 bp, Homo sapiens
ggaggagtgcttgcatggtaagctcccactggagtctgacagggacttaaggacatcacttcattgattctttcagctctgagtatattaagactaagtagtgggtctagaaacatttatttttgaaatttcatgcctggcacaagccagatatctctttttctaactcaacttttttgtctaagagtcagctgtaattaatcagaaaagacttaattgtattaagtactcatttgaaattatctttgaatttgtatttagtcaatattcttcccatgatgctaaatcagattgtatcttgtcctgaaattattatttcagtagtcacattgaatctcaggccacaaaagatctttgggattctcctggacctgtgagctcagcattaagattgctgacatgaaagaaatttattgatcagagttttgtgataggaagtttgtcttttggcttacgtattactaatcattctggagttccttgagtggaacatttataaaatttctaatacagaatgaaggaaggccaagcccctcttggtttaaatattttgatttttgttttctctttctgaccgggcttctttttccttttttatatggttggcacatgggaattcatctcaaggtattggtatatttaacacagtatatatagattcagagagcaagagattcagccttggttttggagtattgttacgtcttcatccagaacttggtt

SEQ ID NO: 289473 - DNA, 355 bp, Homo sapiens
gtgagcgactcaccaggacagttttatttctgtgctgagcttgctgcttcctgctgggaaaatgttagtggcggagtcacacccagaaacaaagtacatttgcttttgaaaagccaagccatacggacgacaaacaatatgatgaaaggtcactcagaaccccaccctagaagaaagccagaagtcctggttcggcccaagaggtgggatgaagagtttcactagatcgtctcccttttggctgatgtcacagcaaatattcatcagccatcagccagactggatagcaggccaaaaacgtggccgtctggtctcacgttggaagttctgttttaaactttgtgaccttgattcc

SEQ ID NO: 289474 - DNA, 3177 bp, Homo sapiens
caggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggagaccagggaatctgaagatttggaaaagacccggaggaaatcagcaagtgatcaatggaacactgataatgaaccagccaaggtgaaacctgagttactcccagaaaaagaggagacttctcaagctgaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaacgcctccttgcagaacagcaatgcagacagacccaggagcccaggaaatgagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcctgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacatcgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtggggggggggcctctgggaagcacaggccagcacctccccaggtggcaggatctggcttggggtgcccggccctcatccctgcccacgcagtgagtgctcatgtgtcttggccccttgcttgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccccttaaggagcccaggtgttttaaggaatgaattggtcactgcatcttgtatcgattatggttctgagaaaagcaaatatcacttttggctgcattaaaagaagcatcatatataaaataaagaagatgaaggtctaaaatttat

SEQ ID NO: 289475 - DNA, 2606 bp, Homo sapiens
tcggaaagcgacgcgcgcgactcggcggcgggacacctgcccggcagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcctgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacatcgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtggggggggggcctctgggaagcacaggccagcacctccccaggtggcaggatctggcttggggtgcccggccctcatccctgcccacgcagtgagtgctcatgtgtcttggccccttgcttgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccccttaaggagcccaggtgttttaaggaatgaattggtcactgcatcttgtatcgattatggttctgagaaaagcaaatatcacttttggctgcattaaaagaagcatcatatataaaataaagaagatgaaggtctaaaatttat

SEQ ID NO: 289476 - DNA, 2596 bp, Homo sapiens
gcgtcgctttccgaggtgggacacctgcccggacagatgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcctgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacatcgtgtaccgttatgcggccgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtggggggggggcctctgggaagcacaggccagcacctccccaggtggcaggatctggcttggggtgcccggccctcatccctgcccacgcagtgagtgctcatgtgtcttggccccttgcttgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccccttaaggagcccaggtgttttaaggaatgaattggtcactgcatcttgtatcgattatggttctgagaaaagcaaatatcacttttggctgcattaaaagaagcatcatatataaaataaagaagatgaaggtctaaaatttat

SEQ ID NO: 289477 - DNA, 1702 bp, Homo sapiens
aaccgcttgtgcaaaggccccaagactgcaagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtggggggggggcctctgggaagcacaggccagcacctccccaggtggcaggatctggcttggggtgcccggccctcatccctgcccacgcagtgagtgctcatgtgtcttggccccttgcttgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccccttaaggagcccaggtgttttaaggaatgaattggtcactgcatcttgtatcgattatggttctgagaaaagcaaatatcacttttggctgcattaaaagaagcatcatatataaaataaagaagatgaaggtctaaaatttat

SEQ ID NO: 289478 - DNA, 1242 bp, Homo sapiens
caggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggagaccagggaatctgaagatttggaaaagacccggaggaaatcagcaagtgatcaatggaacactgataatgaaccagccaaggtgaaacctgagttactcccagaaaaagaggagacttctcaagctgaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaacgcctccttgcagaacagcaatgcagacagacccaggagcccaggaaatgagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcctgaggagattaagctgcaggaggtaacaggcgccgaggggcgggggctcccccacagcacaccggggtggccctcactgctgggggtgaggcttcctctggggggtgaggttccctggctggttcaccagaggaatcgctggcagggttgtccatctagaacatgcagaaaaataaacatggtttcacaggcagcaagaga

SEQ ID NO: 289479 - DNA, 542 bp, Homo sapiens
gtccggctggctagcagccgcctgtgcgcacgcccctcgctagccagccgaggtgaatccttgcttaaaaataaccagcccctgtcctcctccctctctggcagtgagtcgtcctccaccccgggaaatggggccacgcccgaggagtggccggccctggccgacagccccaccacgctcaccgaggccctgcggatgatccaccccattcccgccgactcctggagaaacctcattgaacaaataggtgggtgtctccgcagtaaccgggttttatttgggaaacgcgggtccctggaggactctgagggtcctcctgctcatgggatgccgttgtgtttcatacgaaggactgcgtctgacatgggtaaggaaagcttttgacatgtttggctctaaatggttccgcaggcaaaactgctgcattttaatagcgctgcacaagtgggctttagcaaacatttctgtcctgctctctgcggagaggtctatttgcccagctcttgtctggtgggagggctctctgaccccttatcacttct

SEQ ID NO: 289480 - DNA, 1480 bp, Homo sapiens
gacagagggagactctgtctcaaaaagaaaacacaagttcagctgccttatggagaagctgctaaccctgaccatgtgaaccctgtcctgaccaccccaaaccacacccagggccatatcccaggtacaaaaagttccttctgaagtttaaactaaggccccctcacagcctttatgcatgtatttcttcccagaactcctggctatgttaataacgttttctatggaaacaaatcctcctcttcctcagacgagcccttctccagttgctgtgggagttttcctattctaggcagggctcagctgcgggcttggtgggagtgtgcaggtgggtagtgcggtggtggggatgtgcccgtgcctcttgtccctcagactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtggggggggggcctctgggaagcacaggccagcacctccccaggtggcaggatctggcttggggtgcccggccctcatccctgcccacgcagtgagtgctcatgtgtcttggccccttgcttgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccccttaaggagcccaggtgttttaaggaatgaattggtcactgcatcttgtatcgattatggttctgagaaaagcaaatatcacttttggctgcattaaaagaagcatcatatataaaataaagaagatgaaggtctaaaatttat

SEQ ID NO: 289481 - DNA, 781 bp, Homo sapiens
caggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggagaccagggaatctgaagatttggaaaagacccggaggaaatcagcaagtgatcaatggaacactgataatgaaccagccaaggtgaaacctgagttactcccagaaaaagaggagacttctcaagctgaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaacgcctccttgcagaacagcaatgcagacagacccaggagcccaggaaatgaggtaagagatggcagatcatgaggaatgctggtctgggaaagatgcatcagaggtcattgctgcaaagacttgacagggttacgagggtgtcatgttaaaaaaaataataataacttttggttgcccgtgctaaaaaaataaataaataaaaactccataatta

SEQ ID NO: 289482 - DNA, 2144 bp, Homo sapiens
  misc_feature (354)..(354): n is a, c, g, or t
  misc_feature (491)..(491): n is a, c, g, or t
  misc_feature (901)..(902): n is a, c, g, or t
  misc_feature (904)..(905): n is a, c, g, or t
  misc_feature (908)..(908): n is a, c, g, or t
  misc_feature (912)..(912): n is a, c, g, or t
  misc_feature (915)..(915): n is a, c, g, or t
  misc_feature (920)..(920): n is a, c, g, or t
  misc_feature (922)..(922): n is a, c, g, or t
  misc_feature (924)..(925): n is a, c, g, or t
  misc_feature (927)..(928): n is a, c, g, or t
  misc_feature (930)..(930): n is a, c, g, or t
  misc_feature (1998)..(1998): n is a, c, g, or t
ggcaattagtagtcttctttcattgagaagaattggtatgtcatttaaaaatttaattctagcttcctaaactaaaaaaactccagaaagctcatgcctcattctaatctcagaaagcactgtctaggcttggagatctccccagctgtctaagtagaaagcagaatgaggacttcagtgagcctaatccctgctctgtgttccccatccttccccgacccctagcccccaaggactgggatcaatattggaaacctgtgctttagttcttccacctctgctgctgctatgctgtgtgacctcaggtgagttcctcctctctctggttctcagttttctcacttatgaataganggggttgaaagattcatgctgtagcgggtctgtctcaggtctcagctctgaaggtcattgagtgtcctgttgtcctcagtgatacatgtgagtgaccacccagacggtgcctgaggaagtggtcctttccttgcggnccccatcaatagtctgcctctggattctgacaggggaagctgaattgatggtctctgagtcacagttcctcatgaaaagaggtgcttaacaggagacactcggggactgaggcttcagggacccacccccccccgccaccccgccccacctccactgttctggtgcccctgaggccttcagaagttgttcctatttatccctacgacttctgagggctacgttgctatagcaacctgggtctgctgatctgtgtaaaaaacttatcaattagctgtctggagagtccatttaaggggtaacagagaagcaattactccttatagaggaagcgcaaacagtccccatttcagagcctctcagggagagtctgagaatggcaggtccaagtcactcattttagggacggggnnannttngccnagntcctntnanntnntncctttccttaagaccaagctccagcctcttcaaaaacagcacatctctctctgacacagccactctccctttatcctgtgtattccttcacagctcccctccccatctgcaaccacactctgattgttacgactttgctcgttcccctctctggaataaaaatggtaaaactctgtctcttattcatgaccatttatccacaacctagaactgctcctggcaatgaagaggctcgccacgcctcttgctgaatgagtggatggatggctggatgctaaaagagattcccactaggttctgagaatgaggcatcccagagtaacatcctgtttccttctccgttacctcgacacctgtaggactgggccgactgggagcaccatgtggagaacagagacaaactggagtgccttggggaggaaggaggagagcacagtctctgagtcagccatgaggcagagcaaatacaagtggtcatgcaggaagaagagtgctggttctgcggggtcctaagagggagatgtacggggggtgtgctttgttcaatatgacaacactaccaatggtttagttcttactgcatgagctttacatgtggtgtatctttctggccttgaaactatcctgcagggtaaaacaactgtcccccatcataagaaatgaaggtaacagtgcatgttctcccctcagcctgggacagcttcaccaggcaaattcctgctcattctccaggccatctccccagagaagtccttcctcaacctcaagaacacatcgagttctctgtcttctgttcccacaggaccctgcagtcacccctcctagctcttgctgtaacagtagacacatgatttcggtgtaaatatggacaggacaggaggcagggctggacactgctacatgccccagaacagtgcctgtcctatgatatccaaggaataattatctaatgagtgagatggagcagggaaccctcttaggggccctgcagcaccgcccccgccaagcatggaaataaaatcttgagtttcttcaagggaaattccaggcacctagctagccctgagnagtaaataagcaagctgataagcaagaaggtaatagtaactaacttaaaacaacagccaaggaagctagaatcatgggatgtttgattccctacagaaattaaagataacatcttcacatatgaaccagagttctttttcagaaac

SEQ ID NO: 289483 - DNA, 1006 bp, Homo sapiens
  misc_feature (860)..(860): n is a, c, g, or t
atgccttcctggggtgaggacgctgccaggctcccagctctggagtcaccgccccgtgctaggggcaagagcccccaaggactgggatcaatattggaaacctgtgctttagttcttccacctctgctgctgctatgctgtgtgacctcaggactgggccgactgggagcaccatgtggagaacagagacaaactggagtgccttggggaggaaggaggagagcacagtctctgagtcagccatgaggcagagcaaatacaagtggtcatgcaggaagaagagtgctggttctgcggggtcctaagagggagatgtacggggggtgtgctttgttcaatatgacaacactaccaatggtttagttcttactgcatgagctttacatgtggtgtatctttctggccttgaaactatcctgcagggtaaaacaactgtcccccatcataagaaatgaaggtaacagtgcatgttctcccctcagcctgggacagcttcaccaggcaaattcctgctcattctccaggccatctccccagagaagtccttcctcaacctcaagaacacatcgagttctctgtcttctgttcccacaggaccctgcagtcacccctcctagctcttgctgtaacagtagacacatgatttcggtgtaaatatggacaggacaggaggcagggctggacactgctacatgccccagaacagtgcctgtcctatgatatccaaggaataattatctaatgagtgagatggagcagggaaccctcttaggggccctgcagcaccgcccccgccaagcatggaaataaaatcttgagtttcttcaagggaaattccaggcacctagctagccctgagnagtaaataagcaagctgataagcaagaaggtaatagtaactaacttaaaacaacagccaaggaagctagaatcatgggatgtttgattccctacagaaattaaagataacatcttcacatatgaaccagagttctttttcagaaac

SEQ ID NO: 289484 - DNA, 754 bp, Homo sapiens
tggtttcgacagcctagaaggaacaaaacggcatttccgggaagatggcggcgcacaagtcaggtccggcacatgtttccgcggagcggacccagcaatgacggtaaggggctcccttcccccgaacggtggtagtcggagcccgggcttattagcaaacgtgagaggagcagagtatttttacccaagtggcactggggtaggagggctggaatttagccctcaagagcaaggaagcctagggaaagggcagccggctctttaggactgctgtaagacgagtgaacctggggccacttctgaaaacacagattgactgtagaggggacagtgcccgaagtgtgatcacaggtttcagaaagactggggcgcacagcttctacccagttatccactgaaaatccggtaaagccattcctaactatgccattcagttcaacaaataacgactgaatgtattcttgagttctggcgccgcgttacgtgctctggagtggcggaataaagccggtctcttaacttccagggcatgtagttttcaattattgcgacaagggttaggctgtgtgtggtcttacaggagaaagcacaaagagctgtaagagactgaagagtgtagtgatgaagaacatcagtttttggccgggtgccttggctcacgcctgtaatcccagcactttggtaggtcgagtcaggtggatcaccagaggtcaggagttcgagaccagcccctggccaatatggggaaacccta

SEQ ID NO: 289485 - DNA, 2348 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaaaaaaaaaaaaaaaaaaaaaaattttaaaaaatttagaaaaaaaaaagaaaaaaaaaaaaaaagaaaaaagaaaaagaaagaagaaacagagccaaaaaaaaacagaacaaaataagaaaaggaggaggcaaaaaaagacacgggagagaagaaagagagagacacaagaggacagaagagcaacaagaggggaagcataagagaagcacgacgagacataaacaacacggggccaaaagcacaggagaaataagagaacaaccactaggcggcaaacggacacaccacggagagccggagagaaaagggcaagaagcaaaagatgatcgcaagacgcggagtatac

SEQ ID NO: 289486 - DNA, 2995 bp, Homo sapiens
tttttgaaaaacatgcttgtggagaccacggaattgatttagggagatactcagtgggggagcaaggcggattctgcagacaagctgcctgggcttgaattctacatgttacctgtgtgaccttgaagtcacttaacctttttaggccttactttactcatttgtaaaataggctaatatttccctgaatgggctgggaagattaaatgaaataatctttgtaaagtcttagcacatcctggcatgtggtgagcacaccataaacttaggtatcagaattgacaccattcctccttgacttctctatatgctctttctgtagccagatagggagctccccaaagaccaggccacctccttcctctgtctctggctcaggaaagagaattcttttttctttctttttaattttttttttttctagaggcagggtttcactacgttgcccacactggtctggaactcctgggctcaagtgattcttctaccttggccttccaaagtgctgggattacaaatgtgaaccactgtgcctggccgctttattctttttatgagagagggtcttgctatactgcccaggctggactcaagcaatcccgcctcagcctcccatgtagctgggactacaggtgtgtgccactgcacccaactagcagagaattcttaacaagcagtcaggatggaactgatggctgtttgggcactttctactttcttcttaaaaggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289487 - DNA, 2493 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagtgggatcctgtgaccagccttgctgttgcttacttagactgcccagaccctcagcaggaattgagatcttcaggttccgtggatcctgccatctgttaagggagcagcaatagggcgtgggagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289488 - DNA, 1392 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcgggtagctttaagggggtcctctagagcgcc

SEQ ID NO: 289489 - DNA, 2601 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaagtaagtagtggtcagctccttgagctcccttttctccccacctttgaccatggcctgtgccacctcttggttctttttaccccagggaaatgattcctattacctacccatctattgcctgaagataggcagctccccactcctaccctccaccaactttccctgcaggcttaaggactaggcccatttcccccgataccctcgctttgacttggaccctgtctgtttcagggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289490 - DNA, 1282 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcaaaggatttagcgagacagagggcccc

SEQ ID NO: 289491 - DNA, 1242 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcggcgttggatgcagtcagcggcgtgggatgcagtcagcggcgttggatgcagtcgggtaccga

SEQ ID NO: 289492 - DNA, 2724 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagtgggatcctgtgaccagccttgctgttgcttacttagactgcccagaccctcagcaggaattgagatcttcaggttccgtggatcctgccatctgttaagggagcagcaatagggcgtgggagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaagtaagtagtggtcagctccttgagctcccttttctccccacctttgaccatggcctgtgccacctcttggttctttttaccccagggaaatgattcctattacctacccatctattgcctgaagataggcagctccccactcctaccctccaccaactttccctgcaggcttaaggactaggcccatttcccccgataccctcgctttgacttggaccctgtctgtttcagggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289493 - DNA, 1464 bp, Homo sapiens
cccgtccttcatcatacctaccagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289494 - DNA, 2864 bp, Homo sapiens
tgggtttacaaggtaatatattttgggagatactatgtagtggtacagtacagattctgcagacaagctgcctgggcttgaattctacatgttacctgtgtgaccttgaagtcacttaacctttttaggccttactttactcatttgtaaaataggctaatatttccctgaatgggctgggaagattaaatgaaataatctttgtaaagtcttagcacatcctggcatgtggtgagcacaccataaacttaggtatcagaattgacaccattcctccttgacttctctatatgctctttctgtagccagatagggagctccccaaagaccaggccacctccttcctctgtctctggctcaggaaagagaattcttttttctttctttttaattttttttttttctagaggcagggtttcactacgttgcccacactggtctggaactcctgggctcaagtgattcttctaccttggccttccaaagtgctgggattacaaatgtgaaccactgtgcctggccgctttattctttttatgagagagggtcttgctatactgcccaggctggactcaagcaatcccgcctcagcctcccatgtagctgggactacaggtgtgtgccactgcacccaactagcagagaattcttaacaagcagtcaggatggaactgatggctgtttgggcactttctactttcttcttaaaaggatgatatcacctcttcttctctggtgagagtctgaggatagagacttttttctcaccatgaatgtcaccccagaggtcaagagtcgtgggatgaagtttgctgaggagcagctgctaaagcatggatggactcaaggtgatccccatggggcctcttccacatcccccagctccctgcctaccatctgcccaggggaaagccatcatcctggattacccccccatgtagtccatttaattaaaggaggaaaagctagtttaaagggaaatttgcagaagaaaatttctaactttcccagaaaagggaagaaaggaagaaatttgacagtggataatgaagaagtggtggttgggaggactaggggagggaaaaagagatatgggctctctaccaaaagaatttgaaggaagagatagttcaggctcacacaaaagcaggggactatatggagtggtactagaaagaagtgcgctaggaggtcttctgagaggtacagagtataccccaatgtcaggtgtgtggaatggcaagaggcctgtgtggggggtgccttgtgaggaaggttagcatgtgtgggagaggggacccttgagggcaggtgaggcaggcactcagagctcatatttattcccctggcaggtaggacatgaccctgccaaggagttcacaaaccactggtggaatgagctcttcaacaagactgcggccaacttggtagtggaaactgggcaggtatgagctcttgatagatgggcacatgaaacagagggcctgggacctgtggcgtaggcagtcatgatatgtcacccattcactggtactgataattctctacaggatggagtacagataaggagcctttctaaggagaccacccgttataatcatcccaagcccaacttgctgtatcagaagtttgtgaaggtattagaggctgtgggtaacagagtccatcctttttctcttccctggtttccctggggcctgaacagttgccttgtatgccttatcaattctcagaactttcctaacatagtgggatcctgtgaccagccttgctgttgcttacttagactgcccagaccctcagcaggaattgagatcttcaggttccgtggatcctgccatctgttaagggagcagcaatagggcgtgggaggtagggtacagtctcttaagtcaggagctgccaaattttgggggggccaggggacatctaattcaaaggacttagaagccagaggagacctgagaaattatctggaccatccctgctttgcagatgtggctaaaagggtgaaaagtggtttgctgaagagcccacagctggctagtaatggcaaacaggactggaacccaggacttcaggcctccactttctactgtaccaataggaggaagctaacatgtaatggtcattatgtgctaagggctatacatgttacctagcaaatctttcccatttctctacatctctgttaccatctactaccccacttcgggccatcatcatctcttgcctaatttctttctccagcagcctcctaagaacacctgtagtctcactccccaccccaacctttgtggaggatggacttctccacaaagcatccagtgttctctctaaaacataaatgtcatcatgtcactgggtcttgtttgacctaggatgacacaatccagatttatcggactggcttatatggctctgcatgcctgttcctgccatctccagcctcatctcttcacttttctccaggaccactactttagcctaaccattagcataacagattccaatctgtttcttttctttgaaggtacgacagtcttccatcttcaggttattgcacatgttgctccctctgcttgggacattcttctccctttccccctttaccttctgagtttctcttatcctccagagctcagcttatacatcagttacttttagaagccattctctgaagtctgagttgagtacccttcctctatcacaggcaacacttccatcataattgcctatgtagattccatctgggctgggcccatctcattcttattccactctgaatccccaactccttggcccatagtagactctcaattaatctgattaaatgaaggtactgtgaacaggtactatggtcg

SEQ ID NO: 289495 - DNA, 1235 bp, Homo sapiens
cgcctttaatcccagcactttcagaggcgaggcaggcggatcactgaggtcaggagttcgagaccagcctggccaatatggtgaaaccccgtctctactaaaaatacaaaaattagctgggcgtggtggtgggcacctgtagtcccagcaactcaggatgcttcttgacgtcaagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289496 - DNA, 1104 bp, Homo sapiens
cgtccggattacctcaacacaatgaggctcactcacccaccactattaacctactgggagaactctctgtgctagtaaccacgttctcctgatcaaatatcaccctcctagccttactactaataattattacattttgattaccttcttattatttgatctagaggcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289497 - DNA, 865 bp, Homo sapiens
ttttttcaataaatgcatgctgatttattacagggataaaatgggggtcttggaggaaggaggaaaaggcaaggaggctgcaggcagtgtcaggacagaggaggtagagagcagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289498 - DNA, 2370 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289499 - DNA, 2978 bp, Homo sapiens
tgggtttacaaggtaatatattttgggagatactatgtagtggtacagtacagattctgcagacaagctgcctgggcttgaattctacatgttacctgtgtgaccttgaagtcacttaacctttttaggccttactttactcatttgtaaaataggctaatatttccctgaatgggctgggaagattaaatgaaataatctttgtaaagtcttagcacatcctggcatgtggtgagcacaccataaacttaggtatcagaattgacaccattcctccttgacttctctatatgctctttctgtagccagatagggagctccccaaagaccaggccacctccttcctctgtctctggctcaggaaagagaattcttttttctttctttttaattttttttttttctagaggcagggtttcactacgttgcccacactggtctggaactcctgggctcaagtgattcttctaccttggccttccaaagtgctgggattacaaatgtgaaccactgtgcctggccgctttattctttttatgagagagggtcttgctatactgcccaggctggactcaagcaatcccgcctcagcctcccatgtagctgggactacaggtgtgtgccactgcacccaactagcagagaattcttaacaagcagtcaggatggaactgatggctgtttgggcactttctactttcttcttaaaaggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289500 - DNA, 2296 bp, Homo sapiens
tggtttcgacagcctagaaggaacaaaacggcatttccgggaagatggcggcgcacaagtcaggtccggcacatgtttccgcggagcggacccagcaatgacgaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289501 - DNA, 3748 bp, Homo sapiens
tgggtttacaaggtaatatattttgggagatactatgtagtggtacagtacagattctgcagacaagctgcctgggcttgaattctacatgttacctgtgtgaccttgaagtcacttaacctttttaggccttactttactcatttgtaaaataggctaatatttccctgaatgggctgggaagattaaatgaaataatctttgtaaagtcttagcacatcctggcatgtggtgagcacaccataaacttaggtatcagaattgacaccattcctccttgacttctctatatgctctttctgtagccagatagggagctccccaaagaccaggccacctccttcctctgtctctggctcaggaaagagaattcttttttctttctttttaattttttttttttctagaggcagggtttcactacgttgcccacactggtctggaactcctgggctcaagtgattcttctaccttggccttccaaagtgctgggattacaaatgtgaaccactgtgcctggccgctttattctttttatgagagagggtcttgctatactgcccaggctggactcaagcaatcccgcctcagcctcccatgtagctgggactacaggtgtgtgccactgcacccaactagcagagaattcttaacaagcagtcaggatggaactgatggctgtttgggcactttctactttcttcttaaaaggatgatatcacctcttcttctctggtgagagtctgaggatagagacttttttctcaccatgaatgtcaccccagaggtcaagagtcgtgggatgaagtttgctgaggagcagctgctaaagcatggatggactcaaggtgatccccatggggcctcttccacatcccccagctccctgcctaccatctgcccaggggaaagccatcatcctggattacccccccatgtagtccatttaattaaaggaggaaaagctagtttaaagggaaatttgcagaagaaaatttctaactttcccagaaaagggaagaaaggaagaaatttgacagtggataatgaagaagtggtggttgggaggactaggggagggaaaaagagatatgggctctctaccaaaagaatttgaaggaagagatagttcaggctcacacaaaagcaggggactatatggagtggtactagaaagaagtgcgctaggaggtcttctgagaggtacagagtataccccaatgtcaggtgtgtggaatggcaagaggcctgtgtggggggtgccttgtgaggaaggttagcatgtgtgggagaggggacccttgagggcaggtgaggcaggcactcagagctcatatttattcccctggcaggtaggacatgaccctgccaaggagttcacaaaccactggtggaatgagctcttcaacaagactgcggccaacttggtagtggaaactgggcaggtatgagctcttgatagatgggcacatgaaacagagggcctgggacctgtggcgtaggcagtcatgatatgtcacccattcactggtactgataattctctacaggatggagtacagataaggagcctttctaaggagaccacccgttataatcatcccaagcccaacttgctgtatcagaagtttgtgaaggtattagaggctgtgggtaacagagtccatcctttttctcttccctggtttccctggggcctgaacagttgccttgtatgccttatcaattctcagaactttcctaacatagtgggatcctgtgaccagccttgctgttgcttacttagactgcccagaccctcagcaggaattgagatcttcaggttccgtggatcctgccatctgttaagggagcagcaatagggcgtgggagatggctacattgacttcaggtggagagaagccaaacaaagacttggagagctgcagtgatgacgacaaccaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289502 - DNA, 2487 bp, Homo sapiens
tggtttcgacagcctagaaggaacaaaacggcatttccgggaagatggcggcgcacaagtcaggtccggcacatgtttccgcggagcggacccagcaatgacggatgatatcacctcttcttctctggtgagagtctgaggatagagacttttttctcaccatgaatgtcaccccagaggtcaagagtcgtgggatgaagtttgctgaggagcagctgctaaagcatggatggactcaaggcaaaggcctcggccggaaggagaatggtatcactcaggctctcagggtgacactgaagcaagacactcatggggtaggacatgaccctgccaaggagttcacaaaccactggtggaatgagctcttcaacaagactgcggccaacttggtagtggaaactgggcaggatggagtacagataaggagcctttctaaggagaccacccgttataatcatcccaagcccaacttgctgtatcagaagtttgtgaagatggctacattgacttcaggtggagagaagccaaacaaagacttggagagctgcagtgatgacgacaaccaggggtccaagtccccaaagattacctcaaaaagtgccaggtcctgaacaagaattcagtgttgaaggaatgttttagaaggaggagaggtcaagcctttccaccaggtctgtttgtaactgctgatctcccctaacagtctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289503 - DNA, 1832 bp, Homo sapiens
tatactgtttgcgagaagacgacagaaggggtccaagtccccaaagattctgactgatgagatgctgctccaagcctgtgaggggcgaacagcacacaaggctgcccgtcttgggatcacaatgaaggccaagcttgctcgcctagaggcccaggagcaggccttcctggctcgtctcaaaggccaggaccctggggcccctcaactgcagtcagagagcaagccccccaaaaaaaagaaaaagaaaaggaggcagaaagaggaggaagaagctacagcatctgaaaggaatgatgcagatgagaagcacccagaacatgctgagcagaacatcagaaaaagcaagaagaagaaaaggcgacatcaagaaggaaaggtctcagatgaaagagagggtacaactaaagggaatgagaaggaggacgctgcaggaacaagtgggcttggggaattgaatagcagagagcaaaccaatcagtccctcaggaaagggaagaaaaagaagaggtggcaccatgaagaggagaagatgggggtcttggaggaaggaggaaaaggcaaggaggctgcaggcagtgtcaggacagaggaggtagagagcagggcatatgctgacccatgcagccgaagaaagaagaggcagcaacaggaggaggaggacttgaacctagaagatagaggtgaggaaactgttttaggtggtggaaccagggaagcagagagcagagcatgcagtgatggaagaagcaggaaaagcaagaagaaaagacagcagcatcaagaggaggaggacatcttggatgtaagggatgagaaggatagcggggctagggaagcagagagcagagcacacactggctcaagcagcagaggtaagaggaagaggcagcagcatcccaagaaggaaagagctggagtcagcactgtccagaaagccaaaaagaaacagaagaagagagactaaaggtctggtaaaggtagggctcaattgattgattttcaggagttgaagcctcaaagaccagggttgatgcaggtctgcaggtcttctgcacccccctcaatgaggagtccctcccagaaaggaaactgatctctgggatgtcagctgctgagaggagcaagcggtagtaccaccccttagttgagggagtcagcacagtcctttctgcagcttctaacccaggaccatgaactcaggtgcctagagaagccaggcagctaaaggacaaggaatgctgggggctgtgggaacaggaatgcagataccctttgaaggagcattcctgctaaaagaagctgaaaatgtagacctatgtgaagtgctctgatttctaaatattgtgaaggttaagaaaaacataaatttaggtctatgggctagatttagcccacagttgccagtttctagcgctaccaaatgaatgaataaacatgagcttgcgctcctagcctagagataaatcctgactggcatctctgttcccagcctgggaaggtcctgaatacaaattagaagatattccttggaggcctttgaagaaattccttcggttaacctctttgtagtcttgctacactgataagtagaagtagctccctgtctgtgtcccaaatgaataagaattgtgtaaaggacagcacaactcacttggcatctaacagtccattttcattgtttccaaataccatagcaacctcttgccctttgtgttacccctagagagatggcacccaatccccagggttggtctctgacttccaccattcactgacttttattgccagaggagctcccaggaatccacagttctggaagagaggggctctaa

SEQ ID NO: 289504 - DNA, 1551 bp, Homo sapiens
gcaggggttaaaaggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaggct

SEQ ID NO: 289505 - DNA, 832 bp, Homo sapiens
tgggaggagcaggccagcgattcatgacttcccagccctctctgaagcctcaactgcagcccaagggctccaggtgagacccagccctcttccttcccaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgggggacagggcaagtgagacctggtgagggtggctcagcaggcagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctgagcctgggctctgtccttgagcttgagcctgggcttgagaggtgccactcttattctccaggccctgcccctgccccctcagcatgtcagacacccaccctctagctggtctggcctcttgagtct

SEQ ID NO: 289506 - DNA, 1442 bp, Homo sapiens
acttaggctaggtacgaggcctcgtgtgtaatcggacaccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaggct

SEQ ID NO: 289507 - DNA, 1469 bp, Homo sapiens
  misc_feature (50)..(50): n is a, c, g, or t
ggcgcatacaacgcctagttcagcgtagtactccgccgtgctatagggcntttgtgtcgtcggtctatctcatcccgtgtgaggacagcagaggtcggcaggcagtacacagatggagctactggaccagctgttccttccccgagtcaagaatccccggaggcccggaggcctgcagcaggagcggcataagaagctgatggtgagtgctgagtctgaataatgctgcacctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaggct

SEQ ID NO: 289508 - DNA, 948 bp, Homo sapiens
gcaggggttaaaaggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagtcaccaggccagcccccacacaccctcactcattccagggaagcccaggtaggtggtgaacccgctgccacgtctatcagtcctcttgtttatg

SEQ ID NO: 289509 - DNA, 1524 bp, Homo sapiens
aggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaggct

SEQ ID NO: 289510 - DNA, 1456 bp, Homo sapiens
  misc_feature (11)..(11): n is a, c, g, or t
tgtcgaaccgncgtccgacatgcgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgaaaaaaaaggct

SEQ ID NO: 289511 - DNA, 1315 bp, Homo sapiens
aggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgctatctctgggatcctctagaacactcatca

SEQ ID NO: 289512 - DNA, 418 bp, Homo sapiens
catccagccccttcccctggagagggactgctcagccaacaccaccagctgccacatcctgggctggggcaagacagcagatggtcagtagtgggaggctggtggggagcaggctactggctacttggggaagtgtgccaaaggatggggagtgggaaaattggtgaggggccatgggaagatgggctaatggtgaggaccaatgggacagggtttcaatgggagaaaggtcaagggggagggagagtgaatttgggagctgggccagtgagtgaacagccaatggaaaatgtagaccaatgggtgaatagcatgggagagatggaacataagatgaaggttcaataaagagggaaggtcagtggggagatgctaatcaggaaggatgtcaaaggtcaaaggggactgatcaggattc

SEQ ID NO: 289513 - DNA, 1235 bp, Homo sapiens
tttttttgagacagagtcttgctttgttgtcaggctggagtgcagtggcgccatcttggctcattgcaatctgtctcctgagttcaagagatcctcctgcctcagcctcctgagtagctgggactactggtgtgcaccaccacgcctggctagtttttgtattttcagtcaagacaggatttcaccatgttggccaggctggcctcaaactcctgacctcccatgatctgcccacctcggcatcccaaagtgctgggattataggagtgagccatcgtgcctggccaaactattaatatacataaaaacatgaataaatatcaaaaacagtgtgctgagttaaagaagccaaatgcagaatacatactctgtgactccatttacatgaaactctacaaaacaaatctacagtgatagaaaccagatcagtgtggattgcaatgagtgaggagtaaatgcaaagggtaataaggaaatttgggggcagtggtggggtggtgacagagatgttctacatcttgactgggaagatgattacacaggtatatacatctgctaaaactcactgaattgtacattttaaatgggtacatcttcctgtatataaattatatttcaataaagttgaaaaaagtattttgaaacagttatttaaaagtattttttgttatcaatagtagctggccaacaaatcattatagagattaagcagcccattagtaatataaggttatccttgctccattagccttctgaaacataccggaagaatgagttctctgtccagtggaaatggaggttaatttgttatccaatccacaggagttaaagagtgtgaatatgcacacttctcatcattagcttaagtcgaatttttaaaaatcagaccaagtgctaagaattgaaattaactttttcccaaaaggataatgcttcaaaagatctccattgtgggaaaacaaaacacttcacttcttttttcttcttcttctttttattttattttattttcaagacagggtctcactctgtctcccaggctgagtgtggtggcatgatcatggctcactacagcctcaacctcctagcctcaagccgtcctcccacctcagcctcctgagtaaaaaaaggaagtccctcttcctcccctcctctctctcctttctcaatctctcttatcagagttaatgtctgtcatcagtctgatgagttttttcttttctcggacgcgtggt

SEQ ID NO: 289514 - DNA, 1303 bp, Homo sapiens
aggggaaaatatttttaattcatatactcacaaaggacttgtatccagaatatataaagaactcttaaaactcagtaacaagaagccaaacattccagttttttaaatgggcaaatactttgaatagatttcaccaaatatgagatactggtgacaagaaagcacataaaaagatgctcaatgtcattaaacattaggaaaatgcaaattaaaaccacaatgaggcagcactacacacctactagattttttttttttttttttttttttaagaaactgacaatactaaggccggcacggtggctcatgcctataatcccagcactttgggaggccgagccatcgtgcctggccaaactattaatatacataaaaacatgaataaatatcaaaaacagtgtgctgagttaaagaagccaaatgcagaatacatactctgtgactccatttacatgaaactctacaaaacaaatctacagtgatagaaaccagatcagtgtggattgcaatgagtgaggagtaaatgcaaagggtaataaggaaatttgggggcagtggtggggtggtgacagagatgttctacatcttgactgggaagatgattacacaggtatatacatctgctaaaactcactgaattgtacattttaaatgggtacatcttcctgtatataaattatatttcaataaagttgaaaaaagtattttgaaacagttatttaaaagtattttttgttatcaatagtagctggccaacaaatcattatagagattaagcagcccattagtaatataaggttatccttgctccattagccttctgaaacataccggaagaatgagttctctgtccagtggaaatggaggttaatttgttatccaatccacaggagttaaagagtgtgaatatgcacacttctcatcattagcttaagtcgaatttttaaaaatcagaccaagtgctaagaattgaaattaactttttcccaaaaggataatgcttcaaaagatctccattgtgggaaaacaaaacacttcacttcttttttcttcttcttctttttattttattttattttcaagacagggtctcactctgtctcccaggctgagtgtggtggcatgatcatggctcactacagcctcaacctcctagcctcaagccgtcctcccacctcagcctcctgagtaaaaaaaggaagtccctcttcctcccctcctctctctcctttctcaatctctcttatcagagttaatgtctgtcatcagtctgatgagttttttcttttctcggacgcgtggt

SEQ ID NO: 289515 - DNA, 536 bp, Homo sapiens
cggccgcctggggagccgcgggagaggcggcggcggggggaggagggagaggagggccgagccggcggcccgggaggcccggttttgaagccgcttctctggccgagttaggtttcgcccagcgcaatttctttctctatgtactttgcgaataagtttcggagcatcggttaacagcctatgggtgaaatttggctttcattcatgaatgagtacagatggtgtttcgccttgttggccagcctggtctggaactcctgaccttgtgatctgcccacctcgactctcccaaagtgctaggattacaggtgtgagccaccatgcctggctgacaatttttaataaatgttttgttcacatggctctggaagaattggacctggacaaataattgggttagtctagttttactgtttttcattcagtgccttagtttatactgaagacctagatgacaatttctgttttccataataaagtagctcctggttcagttttgtaaagagttgtgtaagatcaattaacattttgtgcag

SEQ ID NO: 289516 - DNA, 484 bp, Homo sapiens
tgagacagagtctcgctctgtctcccaggcaagaggggcgatcttggctcactgcagcctccgcctctcaggttccaacaattctcctgcctcagcctcccaggtagctgggattacaagcacacaccaccatgcccggctaatttttgtatttttagtagagacgggggtttcactgtgttggccaggctggtctcaaactcctgacctcaggtgatctgcccacctcgactctcccaaagtgctaggattacaggtgtgagccaccatgcctggctgacaatttttaataaatgttttgttcacatggctctggaagaattggacctggacaaataattgggttagtctagttttactgtttttcattcagtgccttagtttatactgaagacctagatgacaatttctgttttccataataaagtagctcctggttcagttttgtaaagagttgtgtaagatcaattaacattttgtgcag

SEQ ID NO: 289517 - DNA, 461 bp, Homo sapiens
cgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacggggga

SEQ ID NO: 289518 - DNA, 1885 bp, Homo sapiens
aggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289519 - DNA, 2157 bp, Homo sapiens
aggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289520 - DNA, 2346 bp, Homo sapiens
aggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289521 - DNA, 2211 bp, Homo sapiens
agccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289522 - DNA, 1937 bp, Homo sapiens
cgcagctcggagcgccggggaagagagagtccgaaccgcggctctgccccgcggcctagcgttgctgcctgctttctccagccccttctcggcgtctggaagtgcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289523 - DNA, 2096 bp, Homo sapiens
gtatcaacgcagagtggtcattatggccggggacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289524 - DNA, 2605 bp, Homo sapiens
aggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaatcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289525 - DNA, 1831 bp, Homo sapiens
aggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289526 - DNA, 4121 bp, Homo sapiens
aggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccagccagctgttttttatcctggttagaagaattttgtgttttcttttagctatggatctttgaacattaccctatgatcgaagagttttgagttgggtttttagatgttggttgtcatggagaaacaggaatctggtgtatgccagccatcatcatcatcatcataaccctttggatgaattttcattatcaagggatctggaaggctgtcttcgctctgcttcccagctaacaaacagatgtgttcccagaagatgatgggcatagggtgtgtttttgcaagtcatttttcccatttacgtagattattcttatttccaattgatcctcaatagataagagtgccattgagctttattttcatctgtcaggcaattaagaaaaaagtaaaggaaacaaaaaagctataatatactaaggaaattcttagattctttggtaaaattaaaagaatcttggtgcatgaatgatccggccctaatctatccatcttgcacatttgggttttcctggatctctcttaaagtggggcacatctctggtcttgatagtcaaggaggagggttggggtaatcagatgtctcaagcagaggtgcatcattgagcctgggtaatggctgaaagtcccccagatatccagtttgaagctgcgttgggcaggccatgggttttattacgtccaaggcgtgacaggcaaccattctataacagaccaactcttgggcttccagaagactgaaaaaagctagaacatttactaatgccaggtgttgcatttgacactttacaagtataacctcactgaaagttccccacaaacatctgaagtagattctgcttttatctccacttcagagacaaggagattgacacttacacagattaaatgatttaatagtgtcgaaagacaaaatcacaacaatttctcttaaagatcttaattacctttatttgcaattccagaattgggtaacacttcattccataaaatagagtaagtgttccaattagctaagcagaagaggttggttttacagccagagaggagtagaagaaagcaaaaaacagaacccagagtggattggtcctttcaaagttaagttccttgtaaggtggggacagggagacagaacaatagaaaagtaactgattggttaacatcaggttactccaggttacttttttgtaaggattacagtagagggaacttaattatcatgctgattgaaactagcctgcttgggaaattaggctgttacctctctcccgatttctcagagggtcagataacaacctattttcagtttggtaaaaatctcagcttgagtgactccattttgattaaattagatttttggggtctagtgcaagaccttagtccaaaacaatgactttctataatttttatttaacaggagggaaacttgagatttgaattcaagccactctgactcaaaagccatggttttctcactcttttgttcattttctcaataagcttgcaaatgcttttaacctctgatgcctgcagccagcatgtacctcaatattgtctgctagtcacatgtaggtaatatttcatcatgtggttaatactaagagggctatgacctcttaataatgatgcatcttaataatgatgctattattgggactttgatttcagaagtaatgcaagatctgcctaaatcctaattatccagcttggaagagtccctgacatctgaatttacaccttttcttcccttcttttttttttgagacggagtttcgcttttgttgcctaggctggagtgcaatggcatgatctcagctcactgcaacctctgcctcccaggttcaagtgattctctcgcctcagcctcccgagtagctgggattacaggtgcctgccaccatgcccaactaatttttgtattttttgtagagacagcgtttcaccatgttggccaggctagtctcaaactcctgacctcaggtgattcacctgtctcggcctcccaaagtgctgggattacaggtgtgagccatcacgcctggccattcctcccttcttttaatctcctttaggtgtctatccagtgcaaccataacccacaagctcttccctatcactcctttcctttctctggaggtaaattttataaatgatgtgtccatcataatagccattttacgttgcagaacaaacaaccccaaactctcggtggcttaaaacaataaagatttctacatctatacacatctgtcataatcaccagggaggctcttttagccactcagaaccaggctgatgaagcagctgcagcacctcctcaaacagctggtctgaggtgctgagctgatgggcaaggagaatcagaggatctcttagtggtgtttaaatgccctgtcacttctgctcctgacagattggccagaactctgtaaaatagtgccacccaaccataagggggccaggaagcacagttctcccctgtgccaagaaggagagaaacagaaatgtttggtgagcggcatggtgtaaccaccacatataccatgccatatatatcctgcttccttctttttttctgcctagcttggcaaatctgacttcacgtaaactttatagaacatgtatagcctctttaattccatttctctttcgcctttgtcttccaaaagtttttcaggtactgcaaaacagtgtctctccttcgtgtaagccaaaaggaaagatctcaagccttgaagtgaaatatacataattcatccctcagtatcttcagggattgatcccaggactcccgcccctgccccctcaaaagccctgccaaggataccaaaatctgaagatgcttaaatctcttatatgaaacggtatagtatttgcatataaccggcatacaccctcacatataccttaaatcatctctaaattacttaataatacctgatacatgtaaatactatgtaaatagttgttatactatattttaaaggtttgtattatttattagtattgtattgttattttttattgcttttttttccctcccccaaatattttcgttctgtggttggttggatccgtggatgggaaacccacgggtacagaggactgaccatattaaagagttagggctactaacctcaaaaagtttctgaatgaccggaagttcttctgatcttcacaaacatctcttgggttttctcacttgctaaaattaaatctgtcttttctccagtgtcaatattcaagataaataaattatgttcacattca

SEQ ID NO: 289527 - DNA, 529 bp, Homo sapiens
ggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaa

SEQ ID NO: 289528 - DNA, 1938 bp, Homo sapiens
ggcttactcactatagggctcgagcggccgcccgggcaggtctagaattcagcggccgctgaattctagcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289529 - DNA, 5653 bp, Homo sapiens
aaaaaagaaaaggaaaagaaaaagaggccatgttatttctacccagagaaagttgtttgacttcccattttaacattcccccttgccatcttgatgaacttgacccatcttaggtttccagcatagcttgtttctcttcatttttatttctaggttgtggccatcaattctgtatttggtcagaaagtgtctttgtattttgcatattggattagagcatctgctcttaattatctgtaggaataagaggcagagagactggggaatagtagaagcccataaacacatctagccaatagtttcaacttcctccccattctgtctcctttgctagaaccactgacagaaaaatcagctgcttctctgttctctcattttattttccttgtccatcatgtgatagggatgttaatatgcaacaaactggctaaaaaaatatcaagagagaaaagtaagggagatggagcatcagtagtgtgtggaggctcctgagagtcaattactaaaaactgagagattttgtgagctcaatcattatgcataaattattgatagattgaatcagccatggtgggagtattacaccacagaaataggcagatgctataaattaagactctccgccaccagatagctgatttaacaacatagcactgatctaggtattatgtcctcctcaataattgagacctcattagggtaagatcagtttatttgtagcctcttttataccaagcccagtgcttagagcagaataggagtgaacaattcaaggaatgatttttttttttttaatgtgtgtcaatcttatattgggttacattgtcttctactatggatcaggccatctcctgattctgtgtctttttctagttactctggggtatctgtagctaccttttcaatttcttagtaggaaggtgttaggcaatctcaacatcatgtgatcattgtttacaacaactcagctctaatagatcagggcctcttttttccttctagcttcgttcatttatctcattagttttctctttttttttcttcctccctcccttctcacctgctttctccctccttctctcctttctgccaacgtttattgaatgtctactgtattactcaacagtaggaagtgttctttcattgagggagctcttacagaccatgagaaaggatggagaggatggggactaacatttattaaacagtctaatatatcccattaccctgcttagccattgcatttcatcttcacaacaacctgatgaggtatgtatgaccctcatttattccaaatgaaacagaaacttaggtcaaatatcctgcccagtcaagtagggaagtcatgaatcaaacccaggttctgcatctcaggataccatattgtataggagctgtaattacatgaataacttattgtaaaatgcattgttaaaggcagtgtagttactttgcggacagggtgccattgacctgctttgagggtttatgaagacaagcccccagaggaaggtatcttgtgtctgagtgttaatagactggaaggagtcctcagacctgctgagtggggaagatcttttggctgaaaggttgaagaagagggtagagatgaggcttctgggaggtgctgtctgagggtgacttggggcagatcttgcaggcctggctgaaaaccttggaatttatcctgagggcagtagggagcagatgtcagctttttaaatggaggggaaaacaacagaactaagtttgtgttttatatcatccctctggaggtcctttggaaaaatggcttggaacaaagcaagggcggagagagggagaccggttaagtgttaggtaggagggaggtagtccttgtgagaagattggagagagagtcagaggttgactctttccttccttggctgcaggctcagatttgccctggagtatgcggctttgagtcacacagattgcacgcttccctttgaggagcggcttccactttgggcaagttggggtaactggcacagattctcttctcaggaaagcaagaggtcgcggtgcagcgggcacaaccctgaactaggaattggaaaacttggggtccactctggttctctgaccttgggccaaacattgaatctctgttatctgtaaattgaagagcctggagccttcaggatttttggtcccttccaaggaggtcccatctgcccagatgtgatagtacattggggtgagagtgctcagaggagaggcaggctccacctatcagtggagtctcagtttctacgtagattgtagtacagattttacctctatgctataatatattctcatttattttgaaaatatacttccttcttaactctgggttttgtttttttttttttttttcacagccagctgttttttatcctggttagaagaattttgtgttttcttttagctatggatctttgaacattaccctatgatcgaagagttttgagttgggtttttagatgttggttgtcatggagaaacaggaatctggtgtatgccagccatcatcatcatcatcataaccctttggatgaattttcattatcaagggatctggaaggctgtcttcgctctgcttcccagctaacaaacagatgtgttcccagaagatgatgggcatagggtgtgtttttgcaagtcatttttcccatttacgtagattattcttatttccaattgatcctcaatagataagagtgccattgagctttattttcatctgtcaggcaattaagaaaaaagtaaaggaaacaaaaaagctataatatactaaggaaattcttagattctttggtaaaattaaaagaatcttggtgcatgaatgatccggccctaatctatccatcttgcacatttgggttttcctggatctctcttaaagtggggcacatctctggtcttgatagtcaaggaggagggttggggtaatcagatgtctcaagcagaggtgcatcattgagcctgggtaatggctgaaagtcccccagatatccagtttgaagctgcgttgggcaggccatgggttttattacgtccaaggcgtgacaggcaaccattctataacagaccaactcttgggcttccagaagactgaaaaaagctagaacatttactaatgccaggtgttgcatttgacactttacaagtataacctcactgaaagttccccacaaacatctgaagtagattctgcttttatctccacttcagagacaaggagattgacacttacacagattaaatgatttaatagtgtcgaaagacaaaatcacaacaatttctcttaaagatcttaattacctttatttgcaattccagaattgggtaacacttcattccataaaatagagtaagtgttccaattagctaagcagaagaggttggttttacagccagagaggagtagaagaaagcaaaaaacagaacccagagtggattggtcctttcaaagttaagttccttgtaaggtggggacagggagacagaacaatagaaaagtaactgattggttaacatcaggttactccaggttacttttttgtaaggattacagtagagggaacttaattatcatgctgattgaaactagcctgcttgggaaattaggctgttacctctctcccgatttctcagagggtcagataacaacctattttcagtttggtaaaaatctcagcttgagtgactccattttgattaaattagatttttggggtctagtgcaagaccttagtccaaaacaatgactttctataatttttatttaacaggagggaaacttgagatttgaattcaagccactctgactcaaaagccatggttttctcactcttttgttcattttctcaataagcttgcaaatgcttttaacctctgatgcctgcagccagcatgtacctcaatattgtctgctagtcacatgtaggtaatatttcatcatgtggttaatactaagagggctatgacctcttaataatgatgcatcttaataatgatgctattattgggactttgatttcagaagtaatgcaagatctgcctaaatcctaattatccagcttggaagagtccctgacatctgaatttacaccttttcttcccttcttttttttttgagacggagtttcgcttttgttgcctaggctggagtgcaatggcatgatctcagctcactgcaacctctgcctcccaggttcaagtgattctctcgcctcagcctcccgagtagctgggattacaggtgcctgccaccatgcccaactaatttttgtattttttgtagagacagcgtttcaccatgttggccaggctagtctcaaactcctgacctcaggtgattcacctgtctcggcctcccaaagtgctgggattacaggtgtgagccatcacgcctggccattcctcccttcttttaatctcctttaggtgtctatccagtgcaaccataacccacaagctcttccctatcactcctttcctttctctggaggtaaattttataaatgatgtgtccatcataatagccattttacgttgcagaacaaacaaccccaaactctcggtggcttaaaacaataaagatttctacatctatacacatctgtcataatcaccagggaggctcttttagccactcagaaccaggctgatgaagcagctgcagcacctcctcaaacagctggtctgaggtgctgagctgatgggcaaggagaatcagaggatctcttagtggtgtttaaatgccctgtcacttctgctcctgacagattggccagaactctgtaaaatagtgccacccaaccataagggggccaggaagcacagttctcccctgtgccaagaaggagagaaacagaaatgtttggtgagcggcatggtgtaaccaccacatataccatgccatatatatcctgcttccttctttttttctgcctagcttggcaaatctgacttcacgtaaactttatagaacatgtatagcctctttaattccatttctctttcgcctttgtcttccaaaagtttttcaggtactgcaaaacagtgtctctccttcgtgtaagccaaaaggaaagatctcaagccttgaagtgaaatatacataattcatccctcagtatcttcagggattgatcccaggactcccgcccctgccccctcaaaagccctgccaaggataccaaaatctgaagatgcttaaatctcttatatgaaacggtatagtatttgcatataaccggcatacaccctcacatataccttaaatcatctctaaattacttaataatacctgatacatgtaaatactatgtaaatagttgttatactatattttaaaggtttgtattatttattagtattgtattgttattttttattgcttttttttccctcccccaaatattttcgttctgtggttggttggatccgtggatgggaaacccacgggtacagaggactgaccatattaaagagttagggctactaacctcaaaaagtttctgaatgaccggaagttcttctgatcttcacaaacatctcttgggttttctcacttgctaaaattaaatctgtcttttctccagtgtcaatattcaagataaataaattatgttcacattca

SEQ ID NO: 289530 - DNA, 2036 bp, Homo sapiens
ctcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289531 - DNA, 2655 bp, Homo sapiens
aggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289532 - DNA, 2093 bp, Homo sapiens
aaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289533 - DNA, 2048 bp, Homo sapiens
  misc_feature (37)..(38): n is a, c, g, or t
  misc_feature (40)..(40): n is a, c, g, or t
  misc_feature (50)..(50): n is a, c, g, or t
  misc_feature (53)..(53): n is a, c, g, or t
atggccatgtatggggctacacataatgaaacaccgnntntggtatttanaanagcagtgtcgtcgatacggatgccggtggggctggcttccctagcatgagccctctcgcccgcagccaccctcaccgcgtggcccgcggacagtgcgcgccggggtcccgggtgcacagcctcaggataccccgtgcccgcagctcgggcgcccgcggcaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289534 - DNA, 2434 bp, Homo sapiens
aggaggctgcctggtgcggaggcggcggcggcggccgcggccgaggtcgaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttggcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactggaaaatta

SEQ ID NO: 289535 - DNA, 2605 bp, Homo sapiens
aggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaatagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttcta

SEQ ID NO: 289536 - DNA, 343 bp, Homo sapiens
tgtggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgt

SEQ ID NO: 289537 - DNA, 382 bp, Homo sapiens
atctgtctactcccaagaaactaaaggacagacactggactgctgctgcagaaacacccacaattccacaggcttgcttgcgttttaatgtccaccaacagtggagttggcttcccggctgtgaatagattcatggaagatgaacaaaaacaaatgaacaaatcaatgacaacaacagcaacatctgtgcatactatagaagcagatgtgtaattattttgtacattggcttaatactgagaaagagactgaataattattgcacttctggcaagtctatatatactgtctcctgacgaaggaccctccagcaacttcgggctgaaatgaagcagattcactcaatccgcacaaactctcagaaaagtgcatctggaaaaaa

SEQ ID NO: 289538 - DNA, 1047 bp, Homo sapiens
ggtctagataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagatacgcttcaccaaaatgaaactttccagatcttcaacttatgaaaacaggtatttatgttgcaacttacatttaaaagatgagtcgaattactcataatccttagaagttagcttgtccgcatctgaaaattcacttttaccttgaagttcaatctgtctctgggaaagactagattggaagaataaaattcaagaatgtgatgttttagtaatggaaaagccaagagcgtcaggtggcaaaagtccttctgttactcaagaaaatgctctgaaaaattccttttctcttttttttttgtaaagattaactccacctcaccaccacaatgaggtatttttctcagcaattgacacctgtttactcagttactccctgtaactatgttatgctgtgaagtaggcaatacagttgttaaagaagaataaa

SEQ ID NO: 289539 - DNA, 741 bp, Homo sapiens
ggtctagataagtgtacatgcttaggccttctgaagcagcatttgaagctgcagtcctgaaaaccatgcaggccggaagagtagataaagaaatatttatttgagatggcacatgtttcttcagaaactcaagatgtttcccccaaagatgaattaactgcttcagaagcctccactaggtctccattgtgtgaacacaccttccctggggactcagacttacggtcaatgattgaagaacatgcttttcaggttttgtcacaaggatccttgttagaaagtccaagttacacagtttgtgtctctgagccagataaagatgatgattttctttctctgaactttcccaggaaactttggaaaatagtggaaagtgaccaattcaagtctatttcatgggatgagaatggaacttgcatagtgattaatgaagaactcttcaagaaagaaattttggaaacaaaggctccttacagaatatttcaaactgatgctatcaaaagttttgttcgacagctcaacctttatggatttagtaaaattcaacagaattttcaaagatctgcctttctagccacctttctgtcagaagagaaagaatcgtctgtcttaagcaagttaaagttctattataatccaaatttcaagcgtggctatccccaacttttagtaagagtgaagagaagaattggtgttaaaaatgcttcacctatatctactttattcaacgaagatttcaac

SEQ ID NO: 289540 - DNA, 401 bp, Homo sapiens
ctttcaaattttttaatgttataaggataaaaagtaaaaacactcactgaaaaataataatcctcactatctcaaccagggccacaataaaactttcaactactatatacaatataatagatagaataatatacaaacacccatgcacctatcatttagctgcaataattaccaacatatagtaataatcatacccagcactcccagctgccttaactaaattattttaaagcaaatctcatgtattttgagatttcgctatatttccctaaaggtggttatgaagagagaagttcatgttctccctagcccacttcccagtggtatgagatgcctaaaataatcatttttaaaagtaggtgatgaaactctctcaatggattatatagaaatcacatgac

SEQ ID NO: 289541 - DNA, 414 bp, Homo sapiens
acatatggaaggaacccatccctggtgggccttgaatgatggaggggcccgaagggcagagtgctccagcctgctcagaagaactatttctaacaatgttttttaatagtattttactgggtccaagtggaggagaacttgatgaccttctccatgtcttctctaggtcaacatcgggcaaggtagccatcctcagaaggtcaaagtgtttgggccaggtgtggagagaagtggtctgaaggcaaatgaacctacacacttcacggtggactgtactgaggctggggaaggtgagaaagggctttgttcaacccagtgatcattgctccttggggaaggcagttcttttcataacgtttcaattccttttgaactaggaagtagtccatctgaataggtaatcatctactgagc

SEQ ID NO: 289542 - DNA, 409 bp, Homo sapiens
tctggggtagaacttagtgtagaaaatgtagaaggtaaggcagtgattttagtagtccagatgtgcagtaaaggcaagagttttatcaaatgagcttgatgtgaacatgccagtgtcatgaggataccactgtacagtctccacactgtatctgtgaacatcaggatgatctctacaaaacagcaatcaaaatttacattaactgacttataaaacaaaagttaacagaagacttctgcaaccctatgcagatacaaccgtgatgcttttggattccttaagatgaaggtttgggaccttaaaacatttgtggtgctatctgaaggaatgagaacacaaagaaggaaagtcttaagtgccagctctggcattaaaacagctgcaaaatacaagaactatagtgcctact

SEQ ID NO: 289543 - DNA, 378 bp, Homo sapiens
atgtgaccttaggagaagggaagagttgcaagggaaagggacttgagagttttatcaaatgagcttgatgtgaacatgccagtgtcatgaggataccactgtacagtctccacactgtatctgtgaacatcaggatgatctctacaaaacagcaatcaaaatttacattaactgacttataaaacaaaagttaacagaagacttctgcaaccctatgcagatacaaccgtgatgcttttggattccttaagatgaaggtttgggaccttaaaacatttgtggtgctatctgaaggaatgagaacacaaagaaggaaagtcttaagtgccagctctggcattaaaacagctgcaaaatacaagaactatagtgcctact

SEQ ID NO: 289544 - DNA, 578 bp, Homo sapiens
agtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggtacgtggtggggcctgggaggagatgggtggagtaggcctggattcgctttggccacttgtgtgcatgtctcatctactttttggtgttttgttagtattattatttttgagatggagtctcactctttcacccaagctagagtgcagtggtgtgatcttggctcactgcaacctctgcctcccaggttcaagtgatcctcccacctcagcctcccaagtagctggggactacaggctcataccaccacccagctaatttttttttaatttgtttttatttttttattttttttttgagatggagttttgctcttgttgcccaagctggagtgcaatggcatgatcttggctcactgcaacctctgcctcccgggttcaagtgattctcctgcctcagcctcccaagtagctgggattacaggc

SEQ ID NO: 289545 - DNA, 1233 bp, Homo sapiens
gagaacagacagacctactgacacaggggaggtgagaagggaggtgaccaccaggactggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcca

SEQ ID NO: 289546 - DNA, 328 bp, Homo sapiens
ccaagtccctactacccaggcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcacttaaatcctcatctgtcctcctttcctgtaaataaaagcccttctatcca

SEQ ID NO: 289547 - DNA, 1125 bp, Homo sapiens
gagaacagacagacctactgacacaggggaggtgagaagggaggtgaccaccaggactggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcca

SEQ ID NO: 289548 - DNA, 1068 bp, Homo sapiens
gagaacagacagacctactgacacaggggaggtgagaagggaggtgaccaccaggactgaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatcca

SEQ ID NO: 289549 - DNA, 980 bp, Homo sapiens
gagaacagacagacctactgacacaggggaggtgagaagggaggtgaccaccaggactggctctgtgagtaccacacagtggggagggggtgggggccaccatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggcagtggctgacatgttgcgtgagaatcgtagcctccagagcctaaacatcgaatccaacttcattagcagcacaggactcatggctgtgctgaaggcagttcgggaaaatgccacactcactgagctccgtgtagacaatcaggtcgccagcaaaagaagagataacactgcatttccctttaccaactagcgctgggagcactggacacttaaatcctcatctgtcctcctttcctgtaaataaaagcccttctatcca

SEQ ID NO: 289550 - DNA, 846 bp, Homo sapiens
caagaaggccctcgccagatgctagcactatgctcctggacttcccaacctccagaacaagtctcgtaaaatgaggaatacctttaaactttaacagaagagttctgaagaccaaactctgaaggaaagaaagcattctggaagaatggcatagctgaaatcaagacccttgaacaaagaatagtacccattaactcttcaaaaactattccacgtaaattcttcccatgagaattgaccagaattattgaacaattacagatctgtaaaaccataaaggtacaaaatcagtctactcactaatgctactggaaagaatgttcttccacaaatcttgcaaggtaacaattctccaacttggacaacacctccattctctaaaacaggaaggaatttaataaataatttatataacttgaaattgtgaaacttcacattttaatgttttctcttagttttataggtaaattatcagtttttgtgaaaaatgttttactgcattttgaaataagcaaaattatctatgaaaaggagcataatacttagttatcagtggtgaaaaaggtcaggataaatatggaggagtcatgatttaaagatatccaaactgatactgctggaaatatctagttttcttgtaattattttaagcaaatcaatttgtcatattctcttaacttataggctatctctatggtaaattactacattttaagaacaaaatttatcttattaatttccaaggcatgaagaaataccattagtgatgagttcagtgacttcctgagatgatttgaagaatctagaataaaacgaatcttactctgtttaccaccaaacaataga

SEQ ID NO: 289551 - DNA, 851 bp, Homo sapiens
ggaggaggagccaaagccaggactttgagaccggcgcgcggtcaagcccaggcagctctccctaaccctccagcactgggcaaacgctgcccgatgacgcccgcctcgggggccacggcatcactggggcgactgcgagcccggccgcggagccgctgggacgcggcttacctcccggctgtcgctgctgtgtgtgttgcccgcgccagtcacgtccctaatgggaccctccgtttcggcgtctgtaaggcgaggaggacgatgcgtcccctccctcgcaggattgaggttaggactaaacggggtccgcagcgcccggcagctcccgagcgctctccccagccgcgcctccctccttcccgccacccgtcccgcaggggcccgcggcgtcacctctcaggctgtagcgcgcctgcatgccgaataccgacagggtgccggtgcccgtgcggtcgtccttcctgacgccgcagcggaggatgtgttggatctgccccaggatttccaggtcccagatgaagagataattctacttactggatataggatgcattagatcttcttaccttaaaaaaaaaaaaaaaggcagcaatgatcaaaatactaataaattactcacagactcagtgtattttttcttggagtaaaagtccaggatgggtaatagaatacctgctgttggcttttggaaaaattggtactgtatgtagcaaaataatgtgaaacccatatgcatggatattcttaacaatttgaagaaatcgtcacagctttcctgggttgttgagcctctaagatggtcttttcctctgatgtgataataaagtgtttattctgaactctacatgcac

SEQ ID NO: 289552 - DNA, 327 bp, Homo sapiens
aacattctcaattgtttaacctggtcaagtctatcacagctgtggttctcagaccctggagagggagtttgcagtgagtagatatctctggagctttttaaaatatagatcccaactgtcaccccaggtgcacagaattaacatctctgagcctaggacctggaatgtcaatttgaaaagcttttcagatgattctgatgtgcatctttaattaggaaccaccaaatgacagccagcagtacaaacctaaagttctcttttgaggaatttttggtctggctgtggtttccacaggttcattactgtgtactattttcacagctcatt

SEQ ID NO: 289553 - DNA, 497 bp, Homo sapiens
aattacacgctctgcaccttttcaaaagagataatggaaatatggttaagataaggagttaagcctatgacagataaccccagggcccaattttccatatattttaaccagaggtgttcccctaagattcttgcttaggaattatgaaatgtagatatccaggtggctttttgttgaaaaagatctatcgattactatcacactcataaatacaaagaaagataaatgtatttggaatgggaactgcatcccacccaaaaatcatgtgttagtttattgcaaagttagttagattgggttctcaaccagctcagactcatagtatgttgatagagagggtctttttatgatctgctagaacttcattcgtcttttatgcaagcaataactgatacaattgctccttttgataacagaaaattatgcaaacaatgcctcccagaggctatccttattttacaccattaaaacatttttactttgtggaaaaaaaaaaa

SEQ ID NO: 289554 - DNA, 804 bp, Homo sapiens
gggcctcactcctggtggttccacctcttttgatattggcaatatctagtgaagttaaaaatgtgtatatccaataacccaaaaattctaattctaggtcctaggaatcctaaagaaattctcacatattgctcaaggaaaggagtactaagttataaactaaagcatcaatcaaagaatggataaataagttgttgaatagtcatactatggaatactttatagaggtgaaaatcagtaaaccagagctatatgtagtagcagatctttaaaataatgtggaaaaaaaggaaaccgcctatataaaaattaagacacaattcattatgatatattgtttatgaatgtacacatatgtagaaaagtataaaaacacatgtggaaatagtgtttgcctctgagaaggaattcacagggagctcacttgtgtttgtaatgttttattttttaagtgctggatggtagatactcagttctcattttctgtacattttggaatatctgaaatatttcacaatttttttatgattatatctggaacctgaggtgagaagacagaagaacccccagtactaacaagaaccctttctatttgcttcaggaagaaggagagagcttcaaagaggaggagagggctatgattgaggtgttctgagaaaatgtcaacccactcaaatgcagagtggtcagactcaaagccaccccaaaataagccagtgcttggaagtgtgtcccatcttcccctcaccataaaggttataatattggttttatttcagataaaacagaatttcatcttccaaa

SEQ ID NO: 289555 - DNA, 2869 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289556 - DNA, 2117 bp, Homo sapiens
aacattccaggaagggaagccagcctgtgaagaagcatggcattgaaacaggaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289557 - DNA, 1798 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcaga

SEQ ID NO: 289558 - DNA, 1737 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactcc

SEQ ID NO: 289559 - DNA, 1217 bp, Homo sapiens
  misc_feature (657)..(657): n is a, c, g, or t
  misc_feature (662)..(662): n is a, c, g, or t
  misc_feature (667)..(667): n is a, c, g, or t
  misc_feature (672)..(672): n is a, c, g, or t
  misc_feature (677)..(677): n is a, c, g, or t
  misc_feature (682)..(682): n is a, c, g, or t
  misc_feature (687)..(687): n is a, c, g, or t
atttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttgcatttgcatttgcatttgcatttgcatttgcatttgcatttcatttnatttnatttnatttnatttnatttnatttnatttatttcatttcatttcattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289560 - DNA, 735 bp, Homo sapiens
gttcttgtttgcaaagggtaaacaagcacaacaaaaaatgatactgttttcaaagggaagttttaaatactattagtaaattaaattctagatgaaacagccatatttttcaaacattgtttttaatatacctacctataaagatctatggagaattcacatcagatcatgaatggatagtactttatgattagagcatacagagagagttacaattaagcttttcttttttcttttacagttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcaga

SEQ ID NO: 289561 - DNA, 2816 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289562 - DNA, 2119 bp, Homo sapiens
gaccgtggcctgcgacggaccctttccagcttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289563 - DNA, 2126 bp, Homo sapiens
gcaggctggtactgcccgagataaggatggaaaaggaagtcaccaccgtggcctgcgaacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289564 - DNA, 2055 bp, Homo sapiens
cttaggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289565 - DNA, 2941 bp, Homo sapiens
ctgtatttaggaatagatactgggaaagttaaatactggtattagagcagaataataaagacactgatcaagacatgacacataaagtttacctaatattccaaattagtagaatgtgtggtgaagtggtctgtatccagaggagatgagaaaaagaactatggattggaaagtttttacagctttctgaggaatatgaattgactttgcacctaggtaaagaagcaaagaggaaaaattcttcttggcctatcaaggtatgtttgaggttacaaactgacatgttttggttgattagctttctactttcacattccgaatgtagacaaatttaaaattatgaaaagtaaggaaattcttatttaagcaaggttattaattggacattactgtatttttggtacctattgtatctgagagtctagagagagtaatagaatcataacattactattctaaaatagtatcttcattgtttaaaccctattcacctccttttcctattgcatttgactttttcatagataaatctgaagttattatttttttaaataatcctttctacatgggagcagtgtatattaggaaattttcaattactttggacctgcacctttgcattgtaggtcagaacctacaaaaattccatcttggaaaacattttagatttaccttgtattcacacacccctgcaaagtgggtctttgcaaacaggaaaggtaaaagatttatttttactgcaaaatcatgcctttatataggattagtctgtggattatttcaggcaacaatgagtagatttttgaaggaaacttcataacacagttttggagccctatcttctgtaacacatttccaacctttggaaatagccttgattttccaacttttaacctgataccaacaaaaatggacaaagataatatcacatggaattattctgaagagccagctgctgagaagttccaggagctgtaaattagacaaaagcatccatttatttgggagtaagttacaatatggctatagcttaaaaatatataatgattcagggaggtattttaatgaacttatgtggcatttattgtgaactattgtatgtttagtattacactgtttttcttctcatgatgtaaaggttcaagcttctgctatcctttgatgtgtgtttgtttttatgaagacagtgcaataattttgtttccactgcattttaagattttttaaaaaataacatttgtaaatgaatattgaaattaaaaatagtaacatcagttttttcttcaatatacagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289566 - DNA, 3107 bp, Homo sapiens
ggcctgccatgtgtacctcttctgtatactccatagtgccagtgcagtaggcatttgatagacactcagtaaatatttataaaatataggacctaagagtatgcttgacacttgtgatttataaattatttctgtttttccagtcaccttcatatatttgtgatttcccacttccatctctggcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgaggtaaagaagcaaagaggaaaaattcttcttggcctatcaaggtatgtttgaggttacaaactgacatgttttggttgattagctttctactttcacattccgaatgtagacaaatttaaaattatgaaaagtaaggaaattcttatttaagcaaggttattaattggacattactgtatttttggtacctattgtatctgagagtctagagagagtaatagaatcataacattactattctaaaatagtatcttcattgtttaaaccctattcacctccttttcctattgcatttgactttttcatagataaatctgaagttattatttttttaaataatcctttctacatgggagcagtgtatattaggaaattttcaattactttggacctgcacctttgcattgtaggtcagaacctacaaaaattccatcttggaaaacattttagatttaccttgtattcacacacccctgcaaagtgggtctttgcaaacaggaaaggtaaaagatttatttttactgcaaaatcatgcctttatataggattagtctgtggattatttcaggcaacaatgagtagatttttgaaggaaacttcataacacagttttggagccctatcttctgtaacacatttccaacctttggaaatagccttgattttccaacttttaacctgataccaacaaaaatggacaaagataatatcacatggaattattctgaagagccagctgctgagaagttccaggagctgtaaattagacaaaagcatccatttatttgggagtaagttacaatatggctatagcttaaaaatatataatgattcagggaggtattttaatgaacttatgtggcatttattgtgaactattgtatgtttagtattacactgtttttcttctcatgatgtaaaggttcaagcttctgctatcctttgatgtgtgtttgtttttatgaagacagtgcaataattttgtttccactgcattttaagattttttaaaaaataacatttgtaaatgaatattgaaattaaaaatagtaacatcagttttttcttcaatatacagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289567 - DNA, 2647 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289568 - DNA, 2230 bp, Homo sapiens
gtaatgacaaaggcactgcatagaaccgagaaaatgtcgtgactgtagtgtgcgcatgctgcgacagatacggcacagctccaaccatcggtgctgcctgggcgacgaacacatggctgaacaagctcttgtttgacatgactaggccgtctcgtggtcttgggaaggcgcaccacatcattgttcacatcgctacactgtattgtcgactctctatagctacatcccgagggagttttatgaggagacgaagtgaaaagacacacttcagaagtttccctggtgagtagtccattgaccgttcaccaaggcataggacagatgggccattggtcgattgcttactctgatacaataccacagtagcaatgcaactgcctttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289569 - DNA, 1806 bp, Homo sapiens
gttcttgtttgcaaagggtaaacaagcacaacaaaaaatgatactgttttcaaagggaagttttaaatactattagtaaattaaattctagatgaaacagccatatttttcaaacattgtttttaatatacctacctataaagatctatggagaattcacatcagatcatgaatggatagtactttatgattagagcatacagagagagttacaattaagcttttcttttttcttttacagttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289570 - DNA, 1611 bp, Homo sapiens
agactctagaggaccccagtttagaagttcatagcatgtgatttcgttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289571 - DNA, 1807 bp, Homo sapiens
gttcttactttagagctgtgacatcaagaaaatttacctctgatcatgccaggattactaaatgttaaaatcagacttcagtatcacaaaacatttttatatctgctccccccctcacaaccacacaacaaataaaagttttcacacattcgactatataccttcttactcaagcagtctgtttgcatataatgaatggaaactcatgaagccaatcatctgagacttggaaatcagaaaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289572 - DNA, 2765 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttctaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289573 - DNA, 978 bp, Homo sapiens
tcgtgccgaattcggcagagggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289574 - DNA, 856 bp, Homo sapiens
cgtggagtaagtccaattgtagaagtcagttgactttccatgtcatggctaccactgtttagtaggtaatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289575 - DNA, 1687 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttctaggaacagtttggggtgggcctgcaaatttagaggctattgctaagaaaggaaaatttaataaataattggtttttcgtgtggatgtactcc

SEQ ID NO: 289576 - DNA, 1839 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcaga

SEQ ID NO: 289577 - DNA, 1714 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcagtttcagacactgaagagaaagtgattctgcgctggcatgtagtgctctacatatttcaaaacatcatgttgtacatttaaaaacttttaagcctggcgtggtggctcatgcctgttatcccagcattttggggggctgaaataggcagatcacctgaggtcaggagtttgagaccagcctggccaacatggtgaaaccctatctctactcaaaatacaaaaattagccaggtgtggtggcacatgcctgtagtcctacaacttgggagtctgaggtggaaggattgcttgaacctgggaggtggaggttacagtgagccaagatcacaccattgcactccagcctgggcaacagagtgagactctgtctcaaataaataaataaataaataaatttgttgagctacaaatt

SEQ ID NO: 289578 - DNA, 1416 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgaggtaatgcagccttctttttaaaatatgatttctaaaagaccaaaaatagctttttgctattccattatttgtactagttaagaaataatagctaattttcaaattacatctattctaatgatgtactatttttttgtgccgtagaggataatcatttaattacatgttaatgaagtatatacatatgtatttta

SEQ ID NO: 289579 - DNA, 1891 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggctt

SEQ ID NO: 289580 - DNA, 572 bp, Homo sapiens
ggcctgccatgtgtacctcttctgtatactccatagtgccagtgcagtaggcatttgatagacactcagtaaatatttataaaatataggacctaagagtatgcttgacacttgtgatttataaattatttctgtttttccagtcaccttcatatatttgtgatttcccacttccatctctggcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcaccggcccaaccaggaccagatcctcaccaacctaagcaagaggaagtgcccctctcaacctgtgcgggctgctgcgtcccaggactgagacgcaggccagccccggcccctagccctcaggccttctttcttatccaaataaatgtttcttaatgagaaaaaaaaaaa

SEQ ID NO: 289581 - DNA, 3947 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgaggtaaagaagcaaagaggaaaaattcttcttggcctatcaaggtatgtttgaggttacaaactgacatgttttggttgattagctttctactttcacattccgaatgtagacaaatttaaaattatgaaaagtaaggaaattcttatttaagcaaggttattaattggacattactgtatttttggtacctattgtatctgagagtctagagagagtaatagaatcataacattactattctaaaatagtatcttcattgtttaaaccctattcacctccttttcctattgcatttgactttttcatagataaatctgaagttattatttttttaaataatcctttctacatgggagcagtgtatattaggaaattttcaattactttggacctgcacctttgcattgtaggtcagaacctacaaaaattccatcttggaaaacattttagatttaccttgtattcacacacccctgcaaagtgggtctttgcaaacaggaaaggtaaaagatttatttttactgcaaaatcatgcctttatataggattagtctgtggattatttcaggcaacaatgagtagatttttgaaggaaacttcataacacagttttggagccctatcttctgtaacacatttccaacctttggaaatagccttgattttccaacttttaacctgataccaacaaaaatggacaaagataatatcacatggaattattctgaagagccagctgctgagaagttccaggagctgtaaattagacaaaagcatccatttatttgggagtaagttacaatatggctatagcttaaaaatatataatgattcagggaggtattttaatgaacttatgtggcatttattgtgaactattgtatgtttagtattacactgtttttcttctcatgatgtaaaggttcaagcttctgctatcctttgatgtgtgtttgtttttatgaagacagtgcaataattttgtttccactgcattttaagattttttaaaaaataacatttgtaaatgaatattgaaattaaaaatagtaacatcagttttttcttcaatatacagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289582 - DNA, 2411 bp, Homo sapiens
cttcagtttagtgttgtcagtgggagaatcctaaaatgtcgccgtggaatggactgtaccgctcgcttctccaaacgtgtcccagacggcgagcctccccggctccgcggcttgtcccttgcaagcgccgcgcaggcctgccccgcgctggacgtggagacgcggtgccgagcgccacgggccggctgtgcgccggccggggaaagagggcgaggggaagagatgaatcggtcttcccagagcgcgccgcgaggtcgcgagattacactttaaaaagcatgaggaggcttgctttctacatgctgatttaatttcggaatacattcgaggccctgtgctaagttagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289583 - DNA, 3436 bp, Homo sapiens
cttcagtttagtgttgtcagtgggagaatcctaaaatgtcgccgtggaatggactgtaccgctcgcttctccaaacgtgtcccagacggcgagcctccccggctccgcggcttgtcccttgcaagcgccgcgcaggcctgccccgcgctggacgtggagacgcggtgccgagcgccacgggccggctgtgcgccggccggggaaagagggcgaggggaagagatgaatcggtcttcccagagcgcgccgcgaggtcgcgagattacactttaaaaagcatgaggaggcttgctttctacatgctgatttaatttcggaatacattcgaggccctgtgctaagttagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatagatggaatggccgtatgcatgttcatgcaaaacaccttaacaagatttatgaggtaaagaagcaaagaggaaaaattcttcttggcctatcaaggtatgtttgaggttacaaactgacatgttttggttgattagctttctactttcacattccgaatgtagacaaatttaaaattatgaaaagtaaggaaattcttatttaagcaaggttattaattggacattactgtatttttggtacctattgtatctgagagtctagagagagtaatagaatcataacattactattctaaaatagtatcttcattgtttaaaccctattcacctccttttcctattgcatttgactttttcatagataaatctgaagttattatttttttaaataatcctttctacatgggagcagtgtatattaggaaattttcaattactttggacctgcacctttgcattgtaggtcagaacctacaaaaattccatcttggaaaacattttagatttaccttgtattcacacacccctgcaaagtgggtctttgcaaacaggaaaggtaaaagatttatttttactgcaaaatcatgcctttatataggattagtctgtggattatttcaggcaacaatgagtagatttttgaaggaaacttcataacacagttttggagccctatcttctgtaacacatttccaacctttggaaatagccttgattttccaacttttaacctgataccaacaaaaatggacaaagataatatcacatggaattattctgaagagccagctgctgagaagttccaggagctgtaaattagacaaaagcatccatttatttgggagtaagttacaatatggctatagcttaaaaatatataatgattcagggaggtattttaatgaacttatgtggcatttattgtgaactattgtatgtttagtattacactgtttttcttctcatgatgtaaaggttcaagcttctgctatcctttgatgtgtgtttgtttttatgaagacagtgcaataattttgtttccactgcattttaagattttttaaaaaataacatttgtaaatgaatattgaaattaaaaatagtaacatcagttttttcttcaatatacagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289584 - DNA, 2910 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289585 - DNA, 2989 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggaaagttgcagatggaatacagagttcctgtacaccctgcatccagtttccccttttattaacatcttatattcctatggatggaatggccgtatgcatgttcatgcaaaacaccttaacaagatttatgaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289586 - DNA, 2815 bp, Homo sapiens
agtagttaactgaatgttttcaccgctttaacgtccagctgcgcttatctttgacatcgactacctaaggtctacctttagtcccacgactctgacaaaatgatctcaatattggtgtaaaatcacctcccctttcaagggtcttccaaagcacttcctgtctgcggcatacaaaatgtattggcacggaattttaagcttactgagctttataaacacgtcacattcacacattcaagacacacactggatattcggataaaaacaaacaaacaaaaaactggctaaatacccattcccctcaataacttggataagatacctaaaaaaggtcgaccttcggtacctttctgtcttctcccctctcgctatttgcctacactggcttcctcacctccactttttctcacgtttatctgagcgaaaacaagcacggttcggcagcctcctttcccagccctacctttgtgctgcaaaagcgaaaattcaaaagccaagtacaataggagaccgcccaccctggctccctcgtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgtatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 289587 - DNA, 2559 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289588 - DNA, 728 bp, Homo sapiens
  misc_feature (41)..(42): n is a, c, g, or t
cctcgcgcccctgtctcccgcacaggaggattaattacgtnnccgcttctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289589 - DNA, 2676 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaaaaaaaaaaaaatattgggcctgtttggccttacgcgtgagaactttagtggccggtttcctcttagggaggaataattcaggatccttcatcattaacccgctcccacggacgaccg

SEQ ID NO: 289590 - DNA, 2412 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289591 - DNA, 2433 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289592 - DNA, 2424 bp, Homo sapiens
  misc_feature (19)..(19): n is a, c, g, or t
gtgggtgtctagaggatcnctcgaatcgacggtttctcacctcgggagcacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289593 - DNA, 2283 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289594 - DNA, 699 bp, Homo sapiens
attcggaacgagggccagttagaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289595 - DNA, 743 bp, Homo sapiens
  misc_feature (17)..(17): n is a, c, g, or t
  misc_feature (21)..(22): n is a, c, g, or t
acaaaaaaaaaaaaacnaaannaagcaaaacgacgccgcggcgattgaaagcacggccgacgcctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289596 - DNA, 1127 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatggaaaacaggactaggaaggtcttcaatctgaaaaagatatctatgagaaggctgaagaaaacatcacaatcaatggtgaaataaaaaagcatttgctttgagattgggacaagaaggatcatccccgcttccatttaacattgtattgtaagaagtatccagtgcattaaagagaata

SEQ ID NO: 289597 - DNA, 1026 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 289598 - DNA, 887 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttggtaagtcttagtcatgaaccacaaatgtaattaacttattaatgtgcttacaataaatttttct

SEQ ID NO: 289599 - DNA, 1219 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccagagctgcaaggcacttcatttatgtatttctctttcgaagtatccgaacagacttctgatataagcaatattttaaaatgcttctgccctttaactttgccaaaataactctttttatgagaaatttgacatctttcagatcagagaagaaaggaaagttgtatttcaatttggaaagaaataatcaaaatatgtgcgattgatgggatacaccagggaatgtggttttaaagcgcagtagtattatatttcagaaatgcatgcctttggcctatttacacttccttttcaaaggttttataaaaaagaggattatgttcttatatagctgtctttgtggcattcctcattttattgatttgtttatataactgtacacattttaaattgctgatatacttaaatggccttatagttttaaaaagctttatgttaaattcccatcctgtatttataattcctggggataaattggtgatttgagactagtgttctgttttgtggatattactgcctgaggtcagaaaataattgttacttgatctactggttaaaagatattagtagaggctagaagaaaatgattacgtgaaattaaatatttgtgcctttttatacaccgaggaagaataatgtacaaatcaaataaaaatgttttaaaattaaacaaa

SEQ ID NO: 289600 - DNA, 1402 bp, Homo sapiens
cgccgctcgtccccgccgcggccgcgccgcctgcagcagcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatggtaaacaaaactgaaaacttgctttatctctgggggaaaaattaaaaattatctttactatagtgcaaaacaaaaatatttgaaaaatgatgaacaaagaattcgtaagtggcatataaaattaataattagccaacattaaatttcaatgtttcaaaaatgtaaaatggttaatttactaaatgggactaatttttgaagggctgccagttttgatcagtatcaaaaacaaaaactccacagccctatagtatgatttaagcattcttactgtgaacattttaaaaataaacaatattaaaatagttttatcttcgttatatatataccaggagtagctttaaaatatgaacactgtttgcagaagtaaaattattttatctagatgctaggtttacttcgaataattttttaaaactctaataaaatctggctttagaaacaagttcagagcaactgtagagatctcattttagaaatttaattattgtaaacagcagtttcttttctctgtaaaacatttttagaccctagaaacaagtgatgtatcaataattttcagatagcctatatggttaattaaatgcatataaatctgtgatattaaggcttcacaatacgtttgtgtcacaaaatatccatttgtttctttatcatcttatgtgaatcactgtgtggatcagacattcaaattttggtatgttcctg

SEQ ID NO: 289601 - DNA, 4335 bp, Homo sapiens
tcctctctcactctaggtcagatgctctgggccatatcctgccccagctggggaaagactggacacaccagggcatcaccagtctctatcacaaaatccaactaaatgggtacaagttcctgtactgctcggcgcgggccattggcatggcggacctcaccaaggggtacctgcagtggagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaagaggacagtgtgggcaccagagggccctggaaacatcttaggggaaggaaaggaaaaggataaatttggagtggggggtctctaaacagattgcctggattccgttctttcctggggttctacagctgcctaagccctcaccttgggggaggatcaaagggaataaagagaactcttggctgagtctttgtgcttctgttctgtcctgaaggacacgtgaggagccagaaacatctggcagcctctggtccttagttcagatacaacatccatgaagctgccaggtgtgaggagagttccagtgggcatcaccttcctgcacaaacctagtcctgatggctgcgaagagaagccgaggggacaaggaacagaagccaccaagggctgtggactgttgcttgtgggcacagggcaatgcggacaggccactggctgtgggcctgtaggtctctgcacagttgctgaggctggtgctgactgcctgcagggtcctctcaaggccttacatacggacactgatcaaggccagtttgccacagcagctgcccctgccagccatgctcaggccctgcagctggctgtccagacactgatttgctgacagtggaatgtgaactctctcaagtctaccctggccttcaagcatgacatccttgccttgaccgctgtccggaactgtccagtttctgcagcactgtgcatgggttttggtggctgggacagccacgtggaggattccctcagtggcctccttagtgccatttgggctagccagggaaggctggaaggcgctgctggataaggctgggctctggggtgatgttccccgagttggtgggatctaggggttgggtcctggccagcctgtctagttggcttgccctggccgcacctgctcagccagctgggcctggcagtccagtaggtcatcccggaggcgggcaatgtcctgcgtgtgctgggccagcgtacgattcagctggtccacatggctccacaggccctctctgggcctcagtggctcagtgggcaagctgtccaggcccgcggccagcaggcccagcctcctgcacgcaccctccacttgtgccacccgctggtcaaagtgtcccactgtgtgctgaagtttctgggctgtgtcctggcagcggctcagcccactggccaccttggccacaccagccttgagttgctccagctccccacgcaggttcaggacctgcctgtggccagcctgaagcctggagccttggctgctgacctgctcctggatggcctggacttcggcttccaccttgcgttcccgctcatccagggacgtgttggcagccaagaaggcatcagagtactggctgacagagtcactgaggcctgtgagcgacttgctcactgagttcagattgaccttgagcagagtgatctcgccttgaagtgagctgcccgtcccttctgccagctgtccctggacctcggccacagtgccattgagctgctggagcagtgctgcgtggctggccacctggcgtaggagggcctcgctccggctctgccaggccttcacctctgccacgaggctgtccaggatggctgaggtggtgctcggggtgcacgaagtctccagtgagaccaaccgttgctctagcacagccagctctgtctgtacaaggggccgagctgacctgcccggagaggcgctgtcatggcttagctccccagccaatgttgctaggcgctcctcgaggctctgcacgcgctcttccagcatggtcccaaagccgcccactccccacccccccatgtccaacctcagacagcatccccttgctccaccctctgtcccattgagcgtctccagaccctcaagcagcccgtccacacctccctcgagcatggcagcagagagcctcgtaagctcatccccggccggggcaccggggcccctttgggtctcggtgactgcctgcagggccctctcaaggccatccatacgggcattgatcaaggctagttgcccacagcagctgcccctgccagacacgctcaggccctgcagctggctgcccagctgtgacagctcctggcgcagggccagctcccggccatcaaggctctggtgcagcctccggctggcggcctgaccctcctcacattgccgccgtacctcctgcacccgcaggtcacactcactctggacgccttgcagcttctgctcaaagccatccagcaggctcccccagagtcggtgcagccgtcggtccacg

SEQ ID NO: 289602 - DNA, 2873 bp, Homo sapiens
tctgttgccccagttcttttttttttttttttttttttgagacagagtctcgctctgtcgcccaggttggagtgcagtggtgtgatctcagttcactgcaaccttcgcctcctgggttcaagcaattctcctgcctcagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaagaggacagtgtgggcaccagagggccctggaaacatcttaggggaaggaaaggaaaaggataaatttggagtggggggtctctaaacagattgcctggattccgttctttcctggggttctacagctgcctaagccctcaccttgggggaggatcaaagggaataaagagaactcttggctgagtctttgtgcttctgttctgtcctgaaggacacgtgaggagccagaaacatctggcagcctctggtccttagttcagatacaacatccatgaagctgccaggtgtgaggagagttccagtgggcatcaccttcctgcacaaacctagtcctgatggctgcgaagagaagccgaggggacaaggaacagaagccaccaagggctgtggactgttgcttgtgggcacagggcaatgcggacaggccactggctgtgggcctgtaggtctctgcacagttgctgaggctggtgctgactgcctgcagggtcctctcaaggccttacatacggacactgatcaaggccagtttgccacagcagctgcccctgccagccatgctcaggccctgcagctggctgtccagacactgatttgctgacagtggaatgtgaactctctcaagtctaccctggccttcaagcatgacatccttgccttgaccgctgtccggaactgtccagtttctgcagcactgtgcatgggttttggtggctgggacagccacgtggaggattccctcagtggcctccttagtgccatttgggctagccagggaaggctggaaggcgctgctggataaggctgggctctggggtgatgttccccgagttggtgggatctaggggttgggtcctggccagcctgtctagttggcttgccctggccgcacctgctcagccagctgggcctggcagtccagtaggtcatcccggaggcgggcaatgtcctgcgtgtgctgggccagcgtacgattcagctggtccacatggctccacaggccctctctgggcctcagtggctcagtgggcaagctgtccaggcccgcggccagcaggcccagcctcctgcacgcaccctccacttgtgccacccgctggtcaaagtgtcccactgtgtgctgaagtttctgggctgtgtcctggcagcggctcagcccactggccaccttggccacaccagccttgagttgctccagctccccacgcaggttcaggacctgcctgtggccagcctgaagcctggagccttggctgctgacctgctcctggatggcctggacttcggcttccaccttgcgttcccgctcatccagggacgtgttggcagccaagaaggcatcagagtactggctgacagagtcactgaggcctgtgagcgacttgctcactgagttcagattgaccttgagcagagtgatctcgccttgaagtgagctgcccgtcccttctgccagctgtccctggacctcggccacagtgccattgagctgctggagcagtgctgcgtggctggccacctggcgtaggagggcctcgctccggctctgccaggccttcacctctgccacgaggctgtccaggatggctgaggtggtgctcggggtgcacgaagtctccagtgagaccaaccgttgctctagcacagccagctctgtctgtacaaggggccgagctgacctgcccggagaggcgctgtcatggcttagctccccagccaatgttgctaggcgctcctcgaggctctgcacgcgctcttccagcatggtcccaaagccgcccactccccacccccccatgtccaacctcagacagcatccccttgctccaccctctgtcccattgagcgtctccagaccctcaagcagcccgtccacacctccctcgagcatggcagcagagagcctcgtaagctcatccccggccggggcaccggggcccctttgggtctcggtgactgcctgcagggccctctcaaggccatccatacgggcattgatcaaggctagttgcccacagcagctgcccctgccagacacgctcaggccctgcagctggctgcccagctgtgacagctcctggcgcagggccagctcccggccatcaaggctctggtgcagcctccggctggcggcctgaccctcctcacattgccgccgtacctcctgcacccgcaggtcacactcactctggacgccttgcagcttctgctcaaagccatccagcaggctcccccagagtcggtgcagccgtcggtccacg

SEQ ID NO: 289603 - DNA, 1749 bp, Homo sapiens
gagaatccttgtcctctccttgcggccgccagtgtggtggaattcctgagcctgccatcccctctggcttcttccctactttggcccccttccctgctgtggttctggccaccccagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgcctctctccagacctcgcttaagcgatacagcgggcga

SEQ ID NO: 289604 - DNA, 1252 bp, Homo sapiens
gagaatccttgtcctctccttgcggccgccagtgtggtggaattcctgagcctgccatcccctctggcttcttccctactttggcccccttccctgctgtggttctggccaccccagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgaattccaccacactggcggccgcaagga

SEQ ID NO: 289605 - DNA, 4273 bp, Homo sapiens
gagaatccttgtcctctccttgcggccgccagtgtggtggaattcctgagcctgccatcccctctggcttcttccctactttggcccccttccctgctgtggttctggccaccccagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaagaggacagtgtgggcaccagagggccctggaaacatcttaggggaaggaaaggaaaaggataaatttggagtggggggtctctaaacagattgcctggattccgttctttcctggggttctacagctgcctaagccctcaccttgggggaggatcaaagggaataaagagaactcttggctgagtctttgtgcttctgttctgtcctgaaggacacgtgaggagccagaaacatctggcagcctctggtccttagttcagatacaacatccatgaagctgccaggtgtgaggagagttccagtgggcatcaccttcctgcacaaacctagtcctgatggctgcgaagagaagccgaggggacaaggaacagaagccaccaagggctgtggactgttgcttgtgggcacagggcaatgcggacaggccactggctgtgggcctgtaggtctctgcacagttgctgaggctggtgctgactgcctgcagggtcctctcaaggccttacatacggacactgatcaaggccagtttgccacagcagctgcccctgccagccatgctcaggccctgcagctggctgtccagacactgatttgctgacagtggaatgtgaactctctcaagtctaccctggccttcaagcatgacatccttgccttgaccgctgtccggaactgtccagtttctgcagcactgtgcatgggttttggtggctgggacagccacgtggaggattccctcagtggcctccttagtgccatttgggctagccagggaaggctggaaggcgctgctggataaggctgggctctggggtgatgttccccgagttggtgggatctaggggttgggtcctggccagcctgtctagttggcttgccctggccgcacctgctcagccagctgggcctggcagtccagtaggtcatcccggaggcgggcaatgtcctgcgtgtgctgggccagcgtacgattcagctggtccacatggctccacaggccctctctgggcctcagtggctcagtgggcaagctgtccaggcccgcggccagcaggcccagcctcctgcacgcaccctccacttgtgccacccgctggtcaaagtgtcccactgtgtgctgaagtttctgggctgtgtcctggcagcggctcagcccactggccaccttggccacaccagccttgagttgctccagctccccacgcaggttcaggacctgcctgtggccagcctgaagcctggagccttggctgctgacctgctcctggatggcctggacttcggcttccaccttgcgttcccgctcatccagggacgtgttggcagccaagaaggcatcagagtactggctgacagagtcactgaggcctgtgagcgacttgctcactgagttcagattgaccttgagcagagtgatctcgccttgaagtgagctgcccgtcccttctgccagctgtccctggacctcggccacagtgccattgagctgctggagcagtgctgcgtggctggccacctggcgtaggagggcctcgctccggctctgccaggccttcacctctgccacgaggctgtccaggatggctgaggtggtgctcggggtgcacgaagtctccagtgagaccaaccgttgctctagcacagccagctctgtctgtacaaggggccgagctgacctgcccggagaggcgctgtcatggcttagctccccagccaatgttgctaggcgctcctcgaggctctgcacgcgctcttccagcatggtcccaaagccgcccactccccacccccccatgtccaacctcagacagcatccccttgctccaccctctgtcccattgagcgtctccagaccctcaagcagcccgtccacacctccctcgagcatggcagcagagagcctcgtaagctcatccccggccggggcaccggggcccctttgggtctcggtgactgcctgcagggccctctcaaggccatccatacgggcattgatcaaggctagttgcccacagcagctgcccctgccagacacgctcaggccctgcagctggctgcccagctgtgacagctcctggcgcagggccagctcccggccatcaaggctctggtgcagcctccggctggcggcctgaccctcctcacattgccgccgtacctcctgcacccgcaggtcacactcactctggacgccttgcagcttctgctcaaagccatccagcaggctcccccagagtcggtgcagccgtcggtccacg

SEQ ID NO: 289606 - DNA, 4214 bp, Homo sapiens
gcctccccaagggccccatccttctgtctcccagcagcctcttctctgccctccacagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttttgtgaacatcttgggagggtgggggttttgcaggggtgttaaaagcaaggcttggagcccctttcctccagctggtggctccttctcagggcctggcctcattcaggccactttgtagagaaatgccctgacctcgcaggaaggatttccccacccccaagtggaaggaagaggacagtgtgggcaccagagggccctggaaacatcttaggggaaggaaaggaaaaggataaatttggagtggggggtctctaaacagattgcctggattccgttctttcctggggttctacagctgcctaagccctcaccttgggggaggatcaaagggaataaagagaactcttggctgagtctttgtgcttctgttctgtcctgaaggacacgtgaggagccagaaacatctggcagcctctggtccttagttcagatacaacatccatgaagctgccaggtgtgaggagagttccagtgggcatcaccttcctgcacaaacctagtcctgatggctgcgaagagaagccgaggggacaaggaacagaagccaccaagggctgtggactgttgcttgtgggcacagggcaatgcggacaggccactggctgtgggcctgtaggtctctgcacagttgctgaggctggtgctgactgcctgcagggtcctctcaaggccttacatacggacactgatcaaggccagtttgccacagcagctgcccctgccagccatgctcaggccctgcagctggctgtccagacactgatttgctgacagtggaatgtgaactctctcaagtctaccctggccttcaagcatgacatccttgccttgaccgctgtccggaactgtccagtttctgcagcactgtgcatgggttttggtggctgggacagccacgtggaggattccctcagtggcctccttagtgccatttgggctagccagggaaggctggaaggcgctgctggataaggctgggctctggggtgatgttccccgagttggtgggatctaggggttgggtcctggccagcctgtctagttggcttgccctggccgcacctgctcagccagctgggcctggcagtccagtaggtcatcccggaggcgggcaatgtcctgcgtgtgctgggccagcgtacgattcagctggtccacatggctccacaggccctctctgggcctcagtggctcagtgggcaagctgtccaggcccgcggccagcaggcccagcctcctgcacgcaccctccacttgtgccacccgctggtcaaagtgtcccactgtgtgctgaagtttctgggctgtgtcctggcagcggctcagcccactggccaccttggccacaccagccttgagttgctccagctccccacgcaggttcaggacctgcctgtggccagcctgaagcctggagccttggctgctgacctgctcctggatggcctggacttcggcttccaccttgcgttcccgctcatccagggacgtgttggcagccaagaaggcatcagagtactggctgacagagtcactgaggcctgtgagcgacttgctcactgagttcagattgaccttgagcagagtgatctcgccttgaagtgagctgcccgtcccttctgccagctgtccctggacctcggccacagtgccattgagctgctggagcagtgctgcgtggctggccacctggcgtaggagggcctcgctccggctctgccaggccttcacctctgccacgaggctgtccaggatggctgaggtggtgctcggggtgcacgaagtctccagtgagaccaaccgttgctctagcacagccagctctgtctgtacaaggggccgagctgacctgcccggagaggcgctgtcatggcttagctccccagccaatgttgctaggcgctcctcgaggctctgcacgcgctcttccagcatggtcccaaagccgcccactccccacccccccatgtccaacctcagacagcatccccttgctccaccctctgtcccattgagcgtctccagaccctcaagcagcccgtccacacctccctcgagcatggcagcagagagcctcgtaagctcatccccggccggggcaccggggcccctttgggtctcggtgactgcctgcagggccctctcaaggccatccatacgggcattgatcaaggctagttgcccacagcagctgcccctgccagacacgctcaggccctgcagctggctgcccagctgtgacagctcctggcgcagggccagctcccggccatcaaggctctggtgcagcctccggctggcggcctgaccctcctcacattgccgccgtacctcctgcacccgcaggtcacactcactctggacgccttgcagcttctgctcaaagccatccagcaggctcccccagagtcggtgcagccgtcggtccacg

SEQ ID NO: 289607 - DNA, 3958 bp, Homo sapiens
gagaatccttgtcctctccttgcggccgccagtgtggtggaattcctgagcctgccatcccctctggcttcttccctactttggcccccttccctgctgtggttctggccaccccagagaggtgatcgagaagaaaccagaggtgttcaaggtcgcctgcctgagtgacatccagcagctgtttctgccccacggacagcccttctatgctgcctttgggaataggcccaatgatgtctttgcctaccggcaggtgggcctgcctgagtcacgcatcttcacagtcaacccccggggagagctcatccaggagctcataaagaaccacaaatccacgtatgagcggcttggtgaagtggtcgagctcctcttcccacctgtggcccgtggccccagcacagacctggccaaccctgaatacagtaacttctgctactggcgggagccactgcctgctgtggaccttgataccctggactgaacctgccctggctggctcctcctccctggcccggcccaggactggctaggtgtcctggggtataggagggtgggaattggagtgtcatggggcaaacccactgaaggggaaggaggaggctgcaggttggttggcagctagagagactcccccatcttccccgtcatatttttgccagctaagctgcagctgctccaggcgtcagtgtggcactgtcctggggcaattagcttgtcatctgggcccttgcagggttctttttttttttttttttttttttcctgagacagggtcttgttctgttgcccaggctggagtgcagtggcatgatctctcggctcactgcaacctccgcctcccgggttcaagcgattcacctgcctcagcctcccaagtagctgggattacaggcgtgtaccaccacgcctggctaattttcgtgtttttagtagagatgggttttcaccacattggccaggctggtctcgaactcctgacctcaagtgatttgcccacctcggcctcccaaagtgctgggattacaggcatgagctaccatgccaggcctccttgcagggttttctatgcccttgatatctgtctccctgtcaacctgggaccttgctgtaagtcttgataggacagggagaagagggaggccctaccgaggctcgaggcttcagtgaagggtgacagcagtgggagtgtggtacagcctctggaaggacacagtgttctccccgccccttgtctgggagccaggactgtaccctccgaagccagacatcactgccaacatatcccccttgctggtgccctggcatctcagcacatgacacacacccacacctgcaggctgtggttccggcttggcctgctccccgtccggctgctgccgctgcctctctccagacctcgcttaaggacagtcccaaactcagctggggcaggtgttggcctgaaagtcctcccccagcctctgctggccagcttggtgctcacagctgctgggtaagctcttgcctaaggagctgtgggaagcagggctgatgccccagcaacctctcctcccactgtctttgaagaaagtagctttagaccggctaaaagctttaatccagagcctgccctactctgatagtaccagagtggagggcagaataccaaatgtccaggaaccaaaggcagggctgtggggacctgaagagcagcacagtggggcccgtgctgctgtgggggaaactgaggctgggagcctcagcagagaccggtgtcaagagtctctgggaactgcataggcctgaggaacatgcattttcaagttgtccattgatggtttcgtacctgaatttctcaccttgggggaggatcaaagggaataaagagaactcttggctgagtctttgtgcttctgttctgtcctgaaggacacgtgaggagccagaaacatctggcagcctctggtccttagttcagatacaacatccatgaagctgccaggtgtgaggagagttccagtgggcatcaccttcctgcacaaacctagtcctgatggctgcgaagagaagccgaggggacaaggaacagaagccaccaagggctgtggactgttgcttgtgggcacagggcaatgcggacaggccactggctgtgggcctgtaggtctctgcacagttgctgaggctggtgctgactgcctgcagggtcctctcaaggccttacatacggacactgatcaaggccagtttgccacagcagctgcccctgccagccatgctcaggccctgcagctggctgtccagacactgatttgctgacagtggaatgtgaactctctcaagtctaccctggccttcaagcatgacatccttgccttgaccgctgtccggaactgtccagtttctgcagcactgtgcatgggttttggtggctgggacagccacgtggaggattccctcagtggcctccttagtgccatttgggctagccagggaaggctggaaggcgctgctggataaggctgggctctggggtgatgttccccgagttggtgggatctaggggttgggtcctggccagcctgtctagttggcttgccctggccgcacctgctcagccagctgggcctggcagtccagtaggtcatcccggaggcgggcaatgtcctgcgtgtgctgggccagcgtacgattcagctggtccacatggctccacaggccctctctgggcctcagtggctcagtgggcaagctgtccaggcccgcggccagcaggcccagcctcctgcacgcaccctccacttgtgccacccgctggtcaaagtgtcccactgtgtgctgaagtttctgggctgtgtcctggcagcggctcagcccactggccaccttggccacaccagccttgagttgctccagctccccacgcaggttcaggacctgcctgtggccagcctgaagcctggagccttggctgctgacctgctcctggatggcctggacttcggcttccaccttgcgttcccgctcatccagggacgtgttggcagccaagaaggcatcagagtactggctgacagagtcactgaggcctgtgagcgacttgctcactgagttcagattgaccttgagcagagtgatctcgccttgaagtgagctgcccgtcccttctgccagctgtccctggacctcggccacagtgccattgagctgctggagcagtgctgcgtggctggccacctggcgtaggagggcctcgctccggctctgccaggccttcacctctgccacgaggctgtccaggatggctgaggtggtgctcggggtgcacgaagtctccagtgagaccaaccgttgctctagcacagccagctctgtctgtacaaggggccgagctgacctgcccggagaggcgctgtcatggcttagctccccagccaatgttgctaggcgctcctcgaggctctgcacgcgctcttccagcatggtcccaaagccgcccactccccacccccccatgtccaacctcagacagcatccccttgctccaccctctgtcccattgagcgtctccagaccctcaagcagcccgtccacacctccctcgagcatggcagcagagagcctcgtaagctcatccccggccggggcaccggggcccctttgggtctcggtgactgcctgcagggccctctcaaggccatccatacgggcattgatcaaggctagttgcccacagcagctgcccctgccagacacgctcaggccctgcagctggctgcccagctgtgacagctcctggcgcagggccagctcccggccatcaaggctctggtgcagcctccggctggcggcctgaccctcctcacattgccgccgtacctcctgcacccgcaggtcacactcactctggacgccttgcagcttctgctcaaagccatccagcaggctcccccagagtcggtgcagccgtcggtccacg

SEQ ID NO: 289608 - DNA, 165 bp, Homo sapiens
ttccatgggcccctcctgtctcccacaggatgtctttgcctaccggcaggtgggcctgcctgagtcacgcatcttcacagtcaacccccggggagagctcatccaggagctcataaagaaccacaaatccacgtgaggctaaaccctgccatgttccccatgccc

SEQ ID NO: 289609 - DNA, 7244 bp, Homo sapiens
atggaagagttaatagttgaacttcgtctctttcttgaactcctggaccatgaatatctaacctcaactgtcagggagaaaaaggcagtgataaccaacattctgctaagaatacagtcatccaaaggttttgacgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccactgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgctactccaaggctgtaacattacgtacatcccgaaagacagcaaaaagaagaagcacgagctgaagattactcagcaggacacggacccgcttgttctcgccgtccagagcaaggaacaggccgggcagtggctgaaggtgatcaaagaagcctacagtggttgtagtggccccgtggattcagagtgtcctcctccaccaagctccccggtgcacaaggcagaactggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaagaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttccctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgccgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacgcctcagggccgtccgctgcactgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacgctcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccgacggcacagctgattggtgctcgactcccagcatgcatattttgttgtaaaaacccaggtttgtaattcacatccacaaccctaagccttttaaagcggaggcaaacgttaacgaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagatttgagggctccctttgtccccctgacctgggcacaggcatgggccatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatgggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 289610 - DNA, 8020 bp, Homo sapiens
  misc_feature (15)..(15): n is a, c, g, or t
acaggctggtaccgnccgggatgtaatggatctggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggtatgaagggtgtgggtgactgcccagggtgcatgtttgtattagagactggagatttcattctgctttgcccaaaggacctattgctcaccaaggctgtcattttatttagtaagagtgggttatctcacagtgtttcttggggcttggaaacattgctggtaaccccgaggcaggtgcctgtgtggtcaaacatgcggcgtgcaggcagaggccagggccagacccacacgctgctcaccgaggcaggggaggtgctgggggacctgttccggcttctggcgctgacaacagagattgtctggaggatggcccctgtatccgcaggacgcagtagattctggtcaccgggtaggagggatcagctggatttctctacagagggtagcccacaggggtcagtaatattcagaagtccagacaagggtagaagcagcccctcgtttgttgagaagggacaggcgagagcaaggcagcatctgtcttgggatgcatcagggaagaggccaggctaatggaatacagacaccagagagggactgaagtcacagaaactgagtttgcagccagagtggcagccctgggccaggcgcgtgcaattcctgctggcgggagctggcgctcagctcctgagcctggggtggcaccgcttacctacgcatggcctcccttccagcccggtgcttagactacggaagactgctccttagattgagattgtactggcctgggctgggacgggggcttcagatgcctcagagccctgggcggtccagagaagaggctgtggccttcccatggctcgccgcgcggggaggagctgacgcacacccagcaggtggttaccagctccagccttgctggactttgtgcctcaatgatctgatgaagggaaatgcttttggagtttagaggagggaaggcaggtgttggcagggcaggtcaggctgaccctataggaggcccaggatgtggcctgcagtctgaggctgaccctacgggaggaggctgtgccagagaatgggacggggcatggagtttaatgagacagaagtagcatttctcccgtgttcccagcttgcaggatagtgaagatgcaggagggccaggagtgcttttggctttgaaaaagagaacctcgcctgccggccaccaccggcccaggccctgggcacaagtccgttcacctcttgggattggtgttctcatctgcccagtgggtgcatcttaggtcactgcagcaaacctcaaataaaataagtgaatgtgccttaaagaaatgtgtgccatgtccagtagagatgcaagctgagctactgttcattgcctcgggcgcaaataagatgactgaaggatcggcggagcattaggggaggacagggttcacactccaagaaggtggcagctttgggaactgtggagtttagggtccacgttttaaaatgagaacattgaggcccagagccaggagctcctggccttcgtcagaatcagcatctcctctttcctggtccgagtcctcaacggctgcagcaaagggaaatggtaggagaaggactctgatcccttagagaactgctgaatttaagtttcacaacgaggacctaagtcaggggagctcgacctcagacgttttgtggaagttcttcttggggaccaggtgccttctctgttgtttggagaacctgtgcctgccgcgggagtaacggcgtttctgggaattccaggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaagaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttccctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgccgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacgcctcagggccgtccgctgcactgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacgctcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccgacggcacagctgattggtgctcgactcccagcatgcatattttgttgtaaaaacccaggtttgtaattcacatccacaaccctaagccttttaaagcggaggcaaacgttaacgaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagatttgagggctccctttgtccccctgacctgggcacaggcatgggccatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatgggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatga

SEQ ID NO: 289611 - DNA, 3536 bp, Homo sapiens
atagctcactcctgatgaaaaacgaccgctagtgaatcctgcaccatgctctacagtgattactgatgtatacgtggtggcgcttgaggcctgcaagggccacgttggattactgaagcggaaagcggtctcccatgtataagaaaaagttttacaacacgaattggaagctgcttgagtccacctgaacttgaattgattgcaaagccatctgccgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacgcctcagggccgtccgctgcactgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacgctcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccgacggcacagctgattggtgctcgactcccagcatgcatattttgttgtaaaaacccaggtttgtaattcacatccacaaccctaagccttttaaagcggaggcaaacgttaacgaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagatttgagggctccctttgtccccctgacctgggcacaggcatgggccatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatgggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 289612 - DNA, 2262 bp, Homo sapiens
gcatgcagtgtggtgagatggttaaaagggggcaagacgtgtggcttctcttattgttagatattttgctatctctcacttctcagggatgaaattctttttcaaagtttggaagttcctgcaacttagccatgatgtgagtggttatccctagataaaattaaaaggatttttacaaagtaattactgcacataaaatgataaataggtaatttgaataattttatttgaagctccttggtttaattattttgtctattgtctcagctataaattcaaatttatacatactattgagtattaatattctctgatttcagggagaattctgtcagtcacatgcatgcacaggcacatgcatgcacccaggcctgggcacaggcatgggccatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatgggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 289613 - DNA, 5757 bp, Homo sapiens
  misc_feature (15)..(15): n is a, c, g, or t
acaggctggtaccgnccgggatgtaatggatctggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggtatgaagggtgtgggtgactgcccagggtgcatgtttgtattagagactggagatttcattctgctttgcccaaaggacctattgctcaccaaggctgtcattttatttagtaagagtgggttatctcacagtgtttcttggggcttggaaacattgctggtaaccccgaggcaggtgcctgtgtggtcaaacatgcggcgtgcaggcagaggccagggccagacccacacgctgctcaccgaggcaggggaggtgctgggggacctgttccggcttctggcgctgacaacagagattgtctggaggatggcccctgtatccgcaggacgcagtagattctggtcaccgggtaggagggatcagctggatttctctacagagggtagcccacaggggtcagtaatattcagaagtccagacaagggtagaagcagcccctcgtttgttgagaagggacaggcgagagcaaggcagcatctgtcttgggatgcatcagggaagaggccaggctaatggaatacagacaccagagagggactgaagtcacagaaactgagtttgcagccagagtggcagccctgggccaggcgcgtgcaattcctgctggcgggagctggcgctcagctcctgagcctggggtggcaccgcttacctacgcatggcctcccttccagcccggtgcttagactacggaagactgctccttagattgagattgtactggcctgggctgggacgggggcttcagatgcctcagagccctgggcggtccagagaagaggctgtggccttcccatggctcgccgcgcggggaggagctgacgcacacccagcaggtggttaccagctccagccttgctggactttgtgcctcaatgatctgatgaagggaaatgcttttggagtttagaggagggaaggcaggtgttggcagggcaggtcaggctgaccctataggaggcccaggatgtggcctgcagtctgaggctgaccctacgggaggaggctgtgccagagaatgggacggggcatggagtttaatgagacagaagtagcatttctcccgtgttcccagcttgcaggatagtgaagatgcaggagggccaggagtgcttttggctttgaaaaagagaacctcgcctgccggccaccaccggcccaggccctgggcacaagtccgttcacctcttgggattggtgttctcatctgcccagtgggtgcatcttaggtcactgcagcaaacctcaaataaaataagtgaatgtgccttaaagaaatgtgtgccatgtccagtagagatgcaagctgagctactgttcattgcctcgggcgcaaataagatgactgaaggatcggcggagcattaggggaggacagggttcacactccaagaaggtggcagctttgggaactgtggagtttagggtccacgttttaaaatgagaacattgaggcccagagccaggagctcctggccttcgtcagaatcagcatctcctctttcctggtccgagtcctcaacggctgcagcaaagggaaatggtaggagaaggactctgatcccttagagaactgctgaatttaagtttcacaacgaggacctaagtcaggggagctcgacctcagacgttttgtggaagttcttcttggggaccaggtgccttctctgttgtttggagaacctgtgcctgccgcgggagtaacggcgtttctgggaattccaggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaagaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttccctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgccgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacgcctcagggccgtccgctgcactgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacgctcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccgacggcacagctgattggtgctcgactcccagcatgcatattttgttgtaaaaacccaggtttgtaattcacatccacaaccctaagccttttaaagcggaggcaaacgttaacgaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaattt

SEQ ID NO: 289614 - DNA, 3608 bp, Homo sapiens
  misc_feature (15)..(15): n is a, c, g, or t
acaggctggtaccgnccgggatgtaatggatctggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggtatgaagggtgtgggtgactgcccagggtgcatgtttgtattagagactggagatttcattctgctttgcccaaaggacctattgctcaccaaggctgtcattttatttagtaagagtgggttatctcacagtgtttcttggggcttggaaacattgctggtaaccccgaggcaggtgcctgtgtggtcaaacatgcggcgtgcaggcagaggccagggccagacccacacgctgctcaccgaggcaggggaggtgctgggggacctgttccggcttctggcgctgacaacagagattgtctggaggatggcccctgtatccgcaggacgcagtagattctggtcaccgggtaggagggatcagctggatttctctacagagggtagcccacaggggtcagtaatattcagaagtccagacaagggtagaagcagcccctcgtttgttgagaagggacaggcgagagcaaggcagcatctgtcttgggatgcatcagggaagaggccaggctaatggaatacagacaccagagagggactgaagtcacagaaactgagtttgcagccagagtggcagccctgggccaggcgcgtgcaattcctgctggcgggagctggcgctcagctcctgagcctggggtggcaccgcttacctacgcatggcctcccttccagcccggtgcttagactacggaagactgctccttagattgagattgtactggcctgggctgggacgggggcttcagatgcctcagagccctgggcggtccagagaagaggctgtggccttcccatggctcgccgcgcggggaggagctgacgcacacccagcaggtggttaccagctccagccttgctggactttgtgcctcaatgatctgatgaagggaaatgcttttggagtttagaggagggaaggcaggtgttggcagggcaggtcaggctgaccctataggaggcccaggatgtggcctgcagtctgaggctgaccctacgggaggaggctgtgccagagaatgggacggggcatggagtttaatgagacagaagtagcatttctcccgtgttcccagcttgcaggatagtgaagatgcaggagggccaggagtgcttttggctttgaaaaagagaacctcgcctgccggccaccaccggcccaggccctgggcacaagtccgttcacctcttgggattggtgttctcatctgcccagtgggtgcatcttaggtcactgcagcaaacctcaaataaaataagtgaatgtgccttaaagaaatgtgtgccatgtccagtagagatgcaagctgagctactgttcattgcctcgggcgcaaataagatgactgaaggatcggcggagcattaggggaggacagggttcacactccaagaaggtggcagctttgggaactgtggagtttagggtccacgttttaaaatgagaacattgaggcccagagccaggagctcctggccttcgtcagaatcagcatctcctctttcctggtccgagtcctcaacggctgcagcaaagggaaatggtaggagaaggactctgatcccttagagaactgctgaatttaagtttcacaacgaggacctaagtcaggggagctcgacctcagacgttttgtggaagttcttcttggggaccaggtgccttctctgttgtttggagaacctgtgcctgccgcgggagtaacggcgtttctgggaattccaggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacaggtgtgtgtccttctggctcacctcggaggctggcgcggccttgcgtggccgagggccagtgcacccagagagaatgtggagtggctctggggcgtagcttgcttgtggccccttagtgtgcccagcagaagacagttcatgtgttagcatcagacactttcatcggccgggcctgtgttcctgacatgctttctcacctctcgctgaaatgttaaaagctgtggaaatgctgagtctgtgtctttcccctttgcacaatctgtttagaacagatccagtcctcgtgtctcttctgaaccaggtcatgatttgatgccagttcagtagagccggtgcttacaaaccgtctaacatgtctgagagttaagccaggtgctggggaaactgaaatgaatgaagcagtctgtgtcctcttagaatcaaacagaacaaagtggggtcctcttcccatgtgagtcatccctgtccctggttcctcttcactcattcggctgagactgctgagaacttagacgtcttctccacttggtcattctgttgagtctcctgtcttgtgagttggatgccgtcactccattgagcgagggaggcactgggcccagagcagtaaacacgcagttgcacatggctggggaggcctcagaatcatggcgggaggcgaa

SEQ ID NO: 289615 - DNA, 447 bp, Homo sapiens
  misc_feature (15)..(15): n is a, c, g, or t
acaggctggtaccgnccgggatgtaatggatctggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggtaagactgcgcttcccggagacgagcagcgtgcacctaagtgggtttcattttctcctgcagtggtgtcggtacccagttcatccaaggctcgttaatttgagctcttttgcattggacttggaatcattcagatagtgggaaatgtattaaatgtttacatttttgcctctta

SEQ ID NO: 289616 - DNA, 8189 bp, Homo sapiens
  misc_feature (15)..(15): n is a, c, g, or t
acaggctggtaccgnccgggatgtaatggatctggagaagaaactgtcttcagagagacccagctcagatggggagggtgttgtggaaaatggaattaccacatgtaatggaaaggagcaagtgaagaggaagaaaagttccaaatcagaggccaagggcactgtgtcgaaagtcactgggaaaaaaatcaccaagatcatcagtctgggaaagaaaaagccgtccacagacgagcagacctcctcagctgaggaagatgttcccacctgcggctatctgaacgtgctctccaacagccgctggcgagagcgctggtgccgagtgaaagataacaagctcattttccacaaggacaggaccgacctgaagacccatattgtgtctattccgctccgtggctgcgaggtgatcccgggtttggattctaaacatcctctgacgttccggctgctgcgcaacggccaggaggttgcagtattggaggcatcttcttctgaagacatgggcaggtggattgggattttactcgcagagacgggatcgtccacagacccggaggctctgcactatgactacattgatgtggagatgtctgcaagtgtcattcagacagccaaacagaccttctgtttcatgaacaggcgtgttatatctgctaacccatatctagggggcacctccaacggctatgcccaccccagcgggacggcacttcattatgacgatgtcccgtgcatcaacggctcgctcaagggtaaaaagccccccgtggcgtctaatggggtcacaggaaaagggaagactctgagcagtcagccaaagaaagcggatcccgcggctgttgtgaaaaggacgggttcgaatgctgcccagtacaagtatggcaagaaccgggtagaagcagatgccaagcggctacagaccaaagaggaggagctgctgaagaggaaagaggccctgcggaataggctggcccagctccgcaaggaaagaaaagaccttcgagcggctattgaagtgaacgccggtatgaagggtgtgggtgactgcccagggtgcatgtttgtattagagactggagatttcattctgctttgcccaaaggacctattgctcaccaaggctgtcattttatttagtaagagtgggttatctcacagtgtttcttggggcttggaaacattgctggtaaccccgaggcaggtgcctgtgtggtcaaacatgcggcgtgcaggcagaggccagggccagacccacacgctgctcaccgaggcaggggaggtgctgggggacctgttccggcttctggcgctgacaacagagattgtctggaggatggcccctgtatccgcaggacgcagtagattctggtcaccgggtaggagggatcagctggatttctctacagagggtagcccacaggggtcagtaatattcagaagtccagacaagggtagaagcagcccctcgtttgttgagaagggacaggcgagagcaaggcagcatctgtcttgggatgcatcagggaagaggccaggctaatggaatacagacaccagagagggactgaagtcacagaaactgagtttgcagccagagtggcagccctgggccaggcgcgtgcaattcctgctggcgggagctggcgctcagctcctgagcctggggtggcaccgcttacctacgcatggcctcccttccagcccggtgcttagactacggaagactgctccttagattgagattgtactggcctgggctgggacgggggcttcagatgcctcagagccctgggcggtccagagaagaggctgtggccttcccatggctcgccgcgcggggaggagctgacgcacacccagcaggtggttaccagctccagccttgctggactttgtgcctcaatgatctgatgaagggaaatgcttttggagtttagaggagggaaggcaggtgttggcagggcaggtcaggctgaccctataggaggcccaggatgtggcctgcagtctgaggctgaccctacgggaggaggctgtgccagagaatgggacggggcatggagtttaatgagacagaagtagcatttctcccgtgttcccagcttgcaggatagtgaagatgcaggagggccaggagtgcttttggctttgaaaaagagaacctcgcctgccggccaccaccggcccaggccctgggcacaagtccgttcacctcttgggattggtgttctcatctgcccagtgggtgcatcttaggtcactgcagcaaacctcaaataaaataagtgaatgtgccttaaagaaatgtgtgccatgtccagtagagatgcaagctgagctactgttcattgcctcgggcgcaaataagatgactgaaggatcggcggagcattaggggaggacagggttcacactccaagaaggtggcagctttgggaactgtggagtttagggtccacgttttaaaatgagaacattgaggcccagagccaggagctcctggccttcgtcagaatcagcatctcctctttcctggtccgagtcctcaacggctgcagcaaagggaaatggtaggagaaggactctgatcccttagagaactgctgaatttaagtttcacaacgaggacctaagtcaggggagctcgacctcagacgttttgtggaagttcttcttggggaccaggtgccttctctgttgtttggagaacctgtgcctgccgcgggagtaacggcgtttctgggaattccaggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacagtctccagtgttccggcaccggaccctggaaaactcgcccatctccagctgtgacaccagtgacaccgagggccccgtgccggtgaacagcgcggccgtcttgaagaagagccaggctgccccgggcagctccccctgccgagggcatgtgctgcggaaggccaaggaatgggaattgaagaacgggacctaggggacagcagcaccactccagcctcagagactgcacacccccttgcctgtatcctcatctgtgtgacggcaggaagctctgcccagagtggcctcagctgcacgactccagaggctccacgactgagctctgaggccagtgcctgtcccccaggcccacttgtattctttctactgtaaaatggcgcctttaaaaaagatgtaagactttggttcccaactttgttaaaaaacaaaaaaagtgatggaaaggtgtttgaaaggatgctatcaggcgaagtgacatctttctaaccagataggccattgctttcaccgattccaacccagccctggactgaggatggatggttccatgagcccccagatgaaaacctggattcgacagggaagagcttggatccccggctgccccgggcatgagtgtggctggccatgggcactgggctcgccttgcacgcccaccaggagggccaggggcatacgcagtcctgacgtggactttgtgtcttggcgtaccctctccacgtgcccgtccccctcgtcatcagaggtaaaggcatgagaaaatcgcgctgtgaaacgttttttaccttttattattattttttggacagatgcttttgtcaccaagacatgaaaagctgccattcttcttaacctgttttttaagaatgtctttttactgtgtgtcacacttagatcaaggagttttcagaggttccttattttattaattaattatttgtgctgcttttgacaggtagcagagggttttaatacttcactaacagtacaccctcctcccccttgggctagcatccccagcccttaatccacgtcggagccggcaggtgcttctcacaccaggagcctctgggggcaggggctggctcctcgccgctgtacaggacgtttactgctgcttggggccagggcagtcctttgaaagggaagcaagttccggaatttgttccctcatggaactataacaccttagagcaagaggcaggaattccagggcctcctgcccctccccttcctccagcttgtcaagttaaaccactaatgtgttggtgggcctggccgtgctgcctctcctgagtagggtgggtgcaagtagggcctctttcccagctttcttgcttgccttctgtgcaatatttcttggagaatttggatgcctaaggcataaaggaaaaaaacagagttcatagtttgagctggtatttaccccctgggtttaaaaatcagattaacttcttggtctcccggaggctgctgtcaggaattctccagtacgggaagatgcagtcacttatgacgaaataagtcacccctgaacgcctccgcaggcagattcatggagaccagtcccagtagcaaccgccccttccccaagcatagaatacagaggtgccatacttggtgtaagccttccttctgtccactgtccagaatgtcctttttcacacagaggaagagatggcgggaaaacactgactgactccttgggtttcccccagacatactttcagagcgctagctgtgtggtgcacgggactttacagttaggattcatgtttaaggtggtggcgcttgaggcctgcaagggccacgttggattactgaagcggaaagcggtctcccatgtataagaaaaagttttacaacacgaattggaagctgcttgagtccacctgaacttgaattgattgcaaagccatctgccgggaacggttttgggttcctgagccatcagccagcctttctttcccctctgatgcacgttcctcccggcctagtccgtggaggcccatcacaccagcatccgtgacgccagcttcccactaggacatccaggcaggtcgggcggggacgccacacgcctcagggccgtccgctgcactgccatagaggagccctccctccagtggtcacttcccaccattgcaggcagacttcccaccattgcaggcagctgggcccacttcatatcacacaaaatgaattttctataaagggaaaaaagtttgctcctccatagatttttgctgccttcgggtcaaatagtttccctggttgacgctcttgggccactctgattggcagcctgctttgccaaagagaactgtgtgaggttttggtggttagtaagagaagggggagatggccagcctgaagtcacggtcctggcccagcacaggtgggcagcagcgagctggcaggtgaagtgtgagcagcacgcaaagtgtcacgtgggccttagccgtcacccaccagcttcctcaccaggcaaggaggccccggagccttagcagggacttgcccgacggcacagctgattggtgctcgactcccagcatgcatattttgttgtaaaaacccaggtttgtaattcacatccacaaccctaagccttttaaagcggaggcaaacgttaacgaaccccatcgtggtccatggagcctttcaaaatgggtgccctggaggggcctgacagtgggttccttccatggcggatactcccttgaaatttcacattccatcaaagtttaaagcatttacttcagaataagttatttatgtgtatatgttcaataaatatagtttttaatttatatctgtacatattagacacacgcgagccatcttgccagaattctgacagtgatgtcattttattcccctcccaaaacatgccccaggaacaagcaccccttgcctctgtggcagctgcgagtgtgtctgatttcataacgaagccaggctgagggcaagaggcccgacaggcaggccagggtccccggagaagccggatttcttcgcaatgtcactggtacttagcagatggtcgtgttcacaggggctagccacctgtactacggtgccgaccgcaatgcgaggaatgtggtggccacgcgatggagctggccggaggacaggtcaggtgagggggccgacccctgcggggctcagggctccttccattctaaccttgagccacagtgtcactcttcagggctctgctcctggctctattttgttaaggtgtcatcagccttcaacctccatttatatatttttataatgttaagccactgaccaactttttcatagaaacaactatcagatttgagggctccctttgtccccctgacctgggcacaggcatgggccatggctccctcttcccagaatctgcggggaactggggcaaggcccatctgtctgcaaggctggtagctctctccctcggcttccagagtccacggcagttgcaaggtaaccagtgtggatctgctgagtcaccccaggcaccagacttaccccaggagcatgggccactgtccatggggccttccttgagaccttcccttggggctggcgggcggcggcttaccagctgggtcagtcccatctcgcccctctgtgcctatgccctggcgttgccaggcttaaccttcccctgtatcttactcatcccagaattattactggccatttctaaatagacaaaaactaccctaaaatgtggagatttactccttttgaaaagtctgtttcaaaaagtgtggcctcagctctggaggccacccccaggaaggagtttgaggttcattgtcattatgggccacagtttggtgcttgtgcacgggactcaaagggcagcgtcgaagctggggttaggtgtagggttgtgagcaaagctcccctgtttgtggccacaccttccctttccaaaaaggctattaattctactcacccactatttggggggatgtaaattttgcccacagactttgccacccaggtgaggtgctgtgttcatgcacggaactgatgtcattagacaccatccaaggatgggcagcctgcagtgtggccggcgactgccatccagagaaaaggcaccttgtgccacagggcggggccgacaccctgagctcacaggtggcccctgcattcaggtggatgtccatccttgaaacagcctcttctgggaacacagcactggaggtctccaggcatcagggttggccggcagggtgccctgcagcttacataaaggtcgtggcaatgtttcaatgttaaactaaactattgccttcctcttacttttcctaaaatgattttctaatgggaacagtcacttcaagttcatgacatagtttgaaggaggataattcattttttcctggttgtcactgtcttcttatccccttggtgggctgggttcatactgtgaaataaactaaaatgaaaccaaaacgttcctgccgtaaatacgtggcacagcactgcagaaaaagcagtcacctctattcgtgagtccccaagccatagcagggcgtctgtaaaagaagggaaactgcacccaggaagtggtgggcgtcagacgcatcctttcgcccgtagttcatgaaatagttccggctttggtcttccagaaaatctcaacttcaccgtgcacaagtgttaccgggtctttttagtgtagccatggaagatactttcaaaaggacatcttcagatcataagtcttaggaccaaaggtgtttttaatgagataatctttttgattttctaacaagaaaggaaatattcactttacattttaacatcaacttttaagtgatattcagaattaattgaccatggtgatacgttgtaaaatgttttcatattaagaatgtaattatttccttattgtattttttaaaagctaaagtcatatttaaaattctctttgaaagaaacaggcaaagaaacagcaaagatttttttaaattaaatatgttagtagtgcccacttcaaatgactgtaaatatattttcactgtttctcaatgtatttaattcataaagtaaaaattttatgaaaagaaacttgcaaggaaaatcctagttttcagtccactcgccccactttgtagtagcttcactgaatttcctgctttcctggttgaattttctactgtttcacgtggtgtaaccctagactggcgcccttggcgtgcccctttgtgtatgaataaacttctctccccc

SEQ ID NO: 289617 - DNA, 748 bp, Homo sapiens
gcccctcttgttttgctttgatctaagttctattagttatgagtagctttatctttaacccatctcgtttattttttgtatatacatctacatacattttatacattatattcatatatacatatatacaaatgtatatatgtttaaagccacgctataagaggaagtaaatgagaaacagacaaatgaagtggtagctggaggacgtgggaatcagtacaggttttcacgcctgtttcagaaatgggagattctacagcacgctcgacactaacacatcacatccataacatatcacatccaatagacaggacagccaaaaacacaaaacaaaaaaagaatcaaatacccacacccagacacaatactcaacaacacaaatacccgaccaaagtctttaagaaagcaaaagaggctgggcacagtggctcacacctgtaatcccagcactctaggaggccaaggtgggtggaccacttgaggtcaggagttcgagaccagcctggccaacatggcaaaacctcgtctctactgaaaatataaaaattagccaggcatggtggcacacgcctgtaatcccagcagtttgggaggctgaggcaggaggctcatttaaggtcaggagttcgagaccagcccgggcaacatggcaaaaccccgtctctactaaaaatacaaaaagttagccaggtgtggtggtgcacgcctgtagtccaagctactcgggaggctgaggcaggagagttac

SEQ ID NO: 289618 - DNA, 1367 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccgaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtg

SEQ ID NO: 289619 - DNA, 2376 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289620 - DNA, 1826 bp, Homo sapiens
ttgtgtcttgaggatcccaatcacaatgttgtggagacagcgccggaagtacggttttcggagggatcagactcagactcacgtcgcactcctcgcagttggactggtgggaactgggaacactggagacctgatttctaactgacgctaccgtcgcggccgccgtaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289621 - DNA, 2301 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289622 - DNA, 2067 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289623 - DNA, 2354 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289624 - DNA, 1504 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctgattcttacggccaaggtcgttaccattggattgttggggtcttgccccatgcatgggatcataacaggtctattggtttgtgagttaaattatttaagataagtgtgcctgaggtgggtttgtcttttgta

SEQ ID NO: 289625 - DNA, 1010 bp, Homo sapiens
gcccctcttgttttgctttgatctaagttctattagttatgagtagctttatctttaacccatctcgtttattttttgtatatacatctacatacattttatacattatattcatatatacatatatacaaatgtatatatgtttaaagccacgctataagaggaagtaaatgagaaacagacaaatgaagtggtagctggaggacgtgggaatcagtacaggttttcacgcctgtttcagaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289626 - DNA, 1197 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289627 - DNA, 501 bp, Homo sapiens
ccccatccttatgggtcgcccactctagttcgcctcattacatcctggcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289628 - DNA, 396 bp, Homo sapiens
taagcaaccgaatggacacatcattttattgccgagatttgacgcctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289629 - DNA, 567 bp, Homo sapiens
acgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtgtgggtgtttctctgagggtcttttctccgggatagacagggaggaggaaggaggacagcaactagagacgacagtgtttctttcggaaaccatcagtcttaagggtactggccttcgtcttctaagtacgcaagtcagaaatatgcaaatgtcgcagacaagcctgctcacctcaacctttaattaactagttcctggcttgaaccatcacggtggccacctaatttgtctccggctgtagtgtgttgccagactgaacttctctgttgtgtgactatgctagacttggggtgtacaagcgtgttgagaaagatacggtttatttcaaactccttccagagaggttgccag

SEQ ID NO: 289630 - DNA, 2400 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289631 - DNA, 2270 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccgtaaaaggcccctccccatcttcagaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaactcaaccagaactcccagctgagccacagttatcaggagaggagtccagctcagaagatgattctgacctgtttgttaacacaaaccgcagacagtatcatgagagtgaggaggagagtgaagaggaggaggcagcctgagactccaggacccaattctccacttgctcagggactggcccctggctcttctgggcttggacattcccagggtgctctgcacatcttcacccctgcatgaggacaaagcagggctcctctctgaactgatcttttgattcagagaattaaacccctggtgggttggtgacttgttctggtgtctgagtggctctctcgggggagggagattgtgatgaagtgaaaaactgctccctatttattagagaccttgtgggtgggtgggctgaatggggaggaaatgggaaatggctggagtctttcccaggtggtttgttctttcttattgggcacttagaaagtgccaggccgtgctctgggccttcttgcatgtgtttaacagctgggagcactcctgcttccttgcctgcttgcagttcataccaatttaagcattcaggatgacagccctaggacctaacacccacctgcctctaagagacgctcaggagcccatggtgcctcgtgctgttctccccacctttctagtcaccctgtgtacgggagtgctcacctccagctactgtgtccatccccacatacgacctcatctctcccactctgcaccatctatcacttccagaaggtggctggcaaatctctctatccttaactttgttttgaatggtccatccatctcctgactttatttgaaacctgattattccctgaggacattgattgtcttataaccttttaaatagaggctgcttttccaccctcacccttcattcttctaaccagccctgacattctcatgagtaaccttctgccttcacttccctcttgtgtagcatcaattccgtagtccaccctacacccctctgtctccctccattctgttccgctagtaaaaccctaaccctgggtaaacccaatcattcacctctgtgcccaaacccaagtcaccatcattaggtgagaaaacagccagcctggccaccagttgtaccttacgtttatcattacaaacctcagatgactggcttggctgttttgaatcctgta

SEQ ID NO: 289632 - DNA, 1361 bp, Homo sapiens
tctccccgcaacccctctggcctccaatcagggccctgctccgcggctggcgctcacccgcaacttcagttcccgtaacggttcctcccgccacccggccgctcctgcggatacctcaagccactagaactttcttccacttccgcttccgggtcgcttcaagagccgcctttaaaaaagaaacattccacgtcgggcacttctagccagttagagctatagagttgaggcgccccggacctcgacggcgtccttagtaggcgctcctttccggtccttcgcagggaagcccatgccattcataagagttctcgcgtatctcgacgacaagattcctgacgggaagaataagggccatccagggaagagtgacttcctttctctgctgcccggacccggaactcaaggacttaggcttgacggacctggcgtggggaagagttagaagacggacaagggaggggacgggaggcctccgagacagcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagcatgtctcaggccaccaagaggaagcatgtggtgaaggaggtgctaggggagcacatagtgccctccgaccagcagcagattgtcagggtactcaggaccccagggaacaatctgcatgaggtggagacagcccaagggcagcgcttcctggtgagcatgccctccaaataccgcaagaacatctggatcaagagaggggactttctcattgttgaccccattgaagagggagaaaaggtgaaggctgaaatctcgtttgtgctctgcaaggaccacgtgcgctctctgcagaaggaggggttttggcctgaggccttctctgaagtggctgagaaacacaacaacaggaacagacaaattcaccagaatcccagtgagccacaagtttcaggagaggatccagatcagaaatgatctgacctgtcgtatacaaccggcgacgatctgaaggggcgggcattcaagaggggggcggaatccggccattcctgtcagaggccggcttggggggaacccgggcgttcccctta

SEQ ID NO: 289633 - DNA, 841 bp, Homo sapiens
ccattcgctcggcacgtctccttcttgctgccttgtgaagaatgtgtcttgcttacccttcgccttccaccattattgtgagtttcctgaggcctccccagccatgctgaactgctagtcaaatgaagcagtgggatatgctgcattttcaaaaagccttcccaggagactacagtgtttgtgctgggtcaagaatcacaaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatggtcagcattttaataacaccataaatccaagataataagtaattctataaagttttccagtttcattaattcagaatttcatcatataacttgaaatccaattggcttcctctttcttagaaacaaaaaccaaagaaacctttttctgaaagacattattttccagtattaggccaatttgtcctcaaattaagtagaatctcaacatcttgttgagccagtttgtaaattccaacttcatttaatgctgctgtggcaggaagctgccctgaagctgactgcagtacatctttcagcagtagtgcagaaccgacgttcaaattcaaaacaatacaggcttcttttatactgtttagggaaaaca

SEQ ID NO: 289634 - DNA, 1118 bp, Homo sapiens
gccctaagcctggatcgcggacagtgacgttggtccacacctcacctgccctctctgccctgctacatgccccaggcttgccctgaaccgtgagctctagaaattccaggtccgggtcgcagccacagggcagtcaggcgtgtcacgtgaccgcgccgggtagagggagacagagtcgcacggctgagacgccaggcagtcgcctagcaacagcgggacgcggagcgatggagaccagcagcagggagctccaagccgcggagtatttggaaaagcatcagatcaaggaggtggttagctacctcaccagcgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatgtgagaaaacaaagggaaaagattccgagtcatatcaaactgcagctgggctgctcctccttcattgaagtgattagcaagaattatctgaaacaaagaataattcatataacagttgtctttattatcacagcccaaaaacagtctattcttacttacttcttggtagatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttctatttttcaagtttttaaatcattttaaatttgaggaagtgttctgtcctagggcattttggataagaaaaaatatacagcctaacattaaaagctctatcagaaaataaatgtacctgtatttata

SEQ ID NO: 289635 - DNA, 988 bp, Homo sapiens
gccctaagcctggatcgcggacagtgacgttggtccacacctcacctgccctctctgccctgctacatgccccaggcttgccctgaaccgtgagctctagaaattccaggtccgggtcgcagccacagggcagtcaggcgtgtcacgtgaccgcgccgggtagagggagacagagtcgcacggctgagacgccaggcagtcgcctagcaacagcgggacgcggagcgatggagaccagcagcagggagctccaagccgcggagtatttggaaaagcatcagatcaaggaggtggttagctacctcaccagcgccctccttttctttcggccggaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatggtcagcattttaataacaccataaatccaagataataaatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttctatttttcaagtttttaaatcattttaaatttgaggaagtgttctgtcctagggcattttggataagaaaaaatatacagcctaacattaaaagctctatcagaaaataaatgtacctgtatttata

SEQ ID NO: 289636 - DNA, 823 bp, Homo sapiens
gccctaagcctggatcgcggacagtgacgttggtccacacctcacctgccctctctgccctgctacatgccccaggcttgccctgaaccgtgagctctagaaattccaggtccgggtcgcagccacagggcagtcaggcgtgtcacgtgaccgcgccgggtagagggagacagagtcgcacggctgagacgccaggcagtcgcctagcaacagcgggacgcggagcgatggagaccagcagcagggagctccaagccgcggagtatttggaaaagcatcagatcaaggaggtggttagctacctcaccagcgccctccttttctttcggccggccctaaaaaccctgggtctatgcactgaagatgaagatttacaagatgatggacataaaataactttggataaattcaaggaggaagtgaacaagaggatgaaggaaatatggtcagcattttaataacaccataaatccaagataataaatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttctatttttcaagtttttaaatcattttaaatttgaggaagtgttctgtcctagggcattttggataagaaaaaatatacagcctaacattaaaagctctatcagaaaataaatgtacctgtatttata

SEQ ID NO: 289637 - DNA, 817 bp, Homo sapiens
ccattcgctcggcacgtctccttcttgctgccttgtgaagaatgtgtcttgcttacccttcgccttccaccattattgtgagtttcctgaggcctccccagccatgctgaactgctagtcaaatgaagcagtgggatatgctgcattttcaaaaagccttcccaggagactacagtgtttgtgctgggtcaagaatcacaaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtgaacaagaggatgaaggaaatatgatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttctatttttcaagtttttaaatcattttaaatttgaggaagtgttctgtcctagggcattttggataagaaaaaatatacagcctaacattaaaagctctatcagaaaataaatgtacctgtatttata

SEQ ID NO: 289638 - DNA, 793 bp, Homo sapiens
ccattcgctcggcacgtctccttcttgctgccttgtgaagaatgtgtcttgcttacccttcgccttccaccattattgtgagtttcctgaggcctccccagccatgctgaactgctagtcaaatgaagcagtgggatatgctgcattttcaaaaagccttcccaggagactacagtgtttgtgctgggtcaagaatcacaaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaagccctaaaaaccctgggtctatgcactgaagatgaagatttacaagatgatggacataaaataactttggataaattcaaggaggaagtatgtatacatccagcttctctacaagcatttgccagaaaattttaaataaggagaaacaaagctgctgctccaactgaagtaaatggtctcgtaacgtcagcagcaacgggcaagccgaactggacagggacatcactgcctgctctgactgagatggcaaggacaaccatctggaaaaaacacatttttaccaaaaaattttcatcagtttctatttttcaagtttttaaatcattttaaatttgaggaagtgttctgtcctagggcattttggataagaaaaaatatacagcctaacattaaaagctctatcagaaaataaatgtacctgtatttata

SEQ ID NO: 289639 - DNA, 738 bp, Homo sapiens
tttttctaaaaaatgcccaggtccagtctctatagttttctattctatcatctgagatagggcatttgtatatgtaattatttaagtgttcaatgtcttaccttcttgctggactgtttatgaaaactaaggcctgtgtccccagcgcctagtacagtgcctttgctatagctgtttaataattgttaaatgactacttctatttgcgacatattttaatttcgtatcagaaagagctggaactattcttttgcagaaaaaccaaaagaatatttaatatctctattggaacgactgagaattgcaaaagtaacaggcgtggcgtttcctttctttatggataactctaacattgtggctatgtttgagatgatggactcctcaggcagaggcaccatatcatttgtgcagtataaagaaggtcagtacattctacaaattgaggtaatagtttgtggtcattccacagttttttctagcagaaaatacttctcactttgtaaaattctcacttcatttcttctcattattttacagccctaaaaaccctgggtctatgcactgaagatgaagatttacaagatgatggacataaaataactttggataaattcaaggaggaagtgtaagtttatttttaagtgacaaatattttaataaggtggcatgattttgaagcacaattaatacctttaaaacaggttcctatcttttgaaagaaatattttgttcccttga

SEQ ID NO: 289640 - DNA, 4091 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289641 - DNA, 2688 bp, Homo sapiens
tgtctctaggagggcccacacaggcaccctggatcccccagagagtagattggtgtgctcaggccgcaggctgactcagaggtagggcagtgggctctgcaggccacctggctggggttggtgggggtcctctctcctgccccagcttccactcagccaccacagttgccacaccatggggtggagacgtgggtcaccacgggcttgggagcaagcgccttctgcagcacaggaagccgaagctggggtcaggtgaggtcgctacccctgaacgtgttcctccggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289642 - DNA, 4180 bp, Homo sapiens
ccgggcgaggggagtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289643 - DNA, 4255 bp, Homo sapiens
ccgggcgaggggagtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccaaaaaaaagaagacaaagaaaagcaacaacacaaacaacaagcgtgggggcacacacttgggggggggggggaaaa

SEQ ID NO: 289644 - DNA, 4286 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacggtgagtaggcaggcccaggagagggccactgggagacggccacctggggtgaggaaaggctcggtatgaccacaggaagggtggggtcgggtgtgaaaccctgggcagcctctaaaggtggaatcaagacacgatgggaactggggtgtgagtgaaactggttgagccgttccccatgccaacccccggtgccagggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289645 - DNA, 3715 bp, Homo sapiens
aactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacgtaaatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289646 - DNA, 3672 bp, Homo sapiens
gtatctctctcctgctctctgtctcacagcaacagaaagcggccctgctgaagaacaacaccgccttgcagtccgtttctcttcgaagtaagaacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289647 - DNA, 3513 bp, Homo sapiens
caacgatggtcctcagctcactgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289648 - DNA, 4023 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcactggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289649 - DNA, 4347 bp, Homo sapiens
ccgggcgaggggagtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccataaggtactgtcttccataatgtctgccaattctgaggaggatggtagtagagagccgggcagtgacctaagttcctctgaaaggggccttttcctctcaccgcaaggacagcctctgcctcactgaagagagggggcactaacaaaagtaaccactgcaaatcttt

SEQ ID NO: 289650 - DNA, 4111 bp, Homo sapiens
ccgggcgaggggagtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289651 - DNA, 4121 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgaggtgagaccctggcggagacatggaccagagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289652 - DNA, 2419 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacaaagagatctggacagaatcgccggacaggtggcagctgccaacaagaagcattagaacaaaccatgctgggttaataaattgcctcattcgtaaaa

SEQ ID NO: 289653 - DNA, 2530 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggtgagacattcattcttcacctttctcagcacagacaagtgttttagtctcttcttgctttcctgcccaagcccacgagagctctggagtcccccagagtcaaacagctataattgttactattaccgtaataataaaaaataagagcagctcacaggtactgttactgtgcacaggcacttttacacctgtgggaaaagattattttcgtcctcattttatagatgatgaaagtaaagcttcaagtcagttaaataatttgtcaagggttgcacacatttctaagtcccttctggctggcaccagtgcctggctcttaactggtattgtaagatgactcttcagtcctttcagtccttgtccagaaggattgaaggcctaaatatgccaagggacaggattcccaggcttaatccttcctttcccctgactggcaggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacgtgagtgtctgcctgccgcctgcatgtgcttatgacctcagggtacctgcagcattagatcccaaccatagaactccctgggaacagaatccagcattcagaggtgggggaagaggttgagggagagacaaaatggcccaagactggaaaggtcacctatgttcttatgtcctgtaaagccacattttatacattgccaacctcaactccctttcaaattcagcatgagctgacaagcaagggaatactttgagctgtcacatggtggcatacctgccagccaacagtacaatttcagctgcattcacatgttcatctgtaggcagagggctgtta

SEQ ID NO: 289654 - DNA, 1480 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacggtgagtaggcaggcccaggagagggccactgggagacggccacctggggtgaggaaaggctcggtatgaccacaggaagggtggggtcgggtgtgaaaccctgggcagcctctaaaggtggaatcaagacacgatgggaactggggtgtgagtgaaactggttgagccgttccccatgccaacccccggtgccagttgggcgctctccggtaccactca

SEQ ID NO: 289655 - DNA, 894 bp, Homo sapiens
agagaggggacccccaccaaagtgctggactgggttcttaaaggggccacctgaagcaggactttttcccacactgaagtcaccaactgacagcagaaacaggtcccccatctttgggatatctcccagttctgctcccagtagaatgtctaagaaatctttgatgaccagtgcaatctgtggaggttatacacttggaggaagggacagcacacgctgatggtttgcagtggtgggaagaccatctgatccagaggcaggaagataagtaaaatgacttcttagagccccttcctgctttcccagctcccctcccccatctcaagcatctgatcccagacctatttcagaatctcctatctctttgctcagtggaagcagtgatatgacatgatgtgatctcatttgagggctaaataaagccattgtgtgagacccagccctggcctctcccctgcaccatttcctgagctcaagaggctaagggaaaatgggaggggggctaggagagttaatctaatggaaaaagaagcaacacgatgatgggacccccagtttgaatttcagacagtggaggagggaatattgctaggagggagttgaggaagccttgttaaacctcatctctttgagggacagaataaaaagtattggcatcatagcatagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289656 - DNA, 187 bp, Homo sapiens
ccaagagtgtttctaccaccaacattgctgggtgagcctctgtttggggaaaggggcagccagagagtgtggcagtggaggccaagggggtgctgagaggtccctttccatccctgagttcagaactgtagacagacaaataaggagaacttagggggaccgcctcttggatcctggctttggttcc

SEQ ID NO: 289657 - DNA, 632 bp, Homo sapiens
gccagtgcagggggcattcccccagatgcccaagtgtcccacatgtgggggtgaatggcattcccctcagggtcctgtgtcattcctgttctcacctcttcctctttccccacagtggagggtctgaaagacctgctggtggggccaggagtggaactgctcttgacaccccgagagccagccctgcccttggaaccagacagcggtggtaacacgagtcctggggtcactgccagtgagtaccagggcaggggaccaaggtagtaggtgggaggggccaaagttagtagagtggtaccagggatcaagtggtatcagggccccagggaagtgagctcagccatccttttctccttctcaacagatggtgaggccagaaccttcaatggctccattgaactctgcagagctgactcagactctagccagagggtaggtcctcaagaggttctgggacttggcaagagggtgggagagggacagccagcctctggatcctcaacacaaagctgtcaggggcaggcacccaggatttgtgtgcctgctgactccccattcttgcccatttctgcaggatcgaaatggaaatcagctgagatcaccgcaagaggtgagatgggaattgatggtat

SEQ ID NO: 289658 - DNA, 4074 bp, Homo sapiens
gctgggcagtgcccatgctgggatgtgctgctgctgtggctgctgcccgctgctggcccacctagagcaggggtcacttcgagagaggacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289659 - DNA, 562 bp, Homo sapiens
tgaaggatattgagatactggttggagaactgaaaagaaatgtagatgggtgcaggggtggaggaaattaactcgggtcgtggtgctgaaagaggccagttggtggtggatctcctgaaggggactcatgggtgagccccaggggggagagctgctgccttcagccaagcagaacctccaatcttcacactactcagtccctgacctgctgttcttcctgcccactgtccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgaggtgagaccctggcggagacatggaccagaggtagagtgcagcctgggtacgtgtgagcttgtataactctagggctcctgtatagaagcaggaggggcctctctcctccaactggttggtgattcccaacctttagaagtaaaa

SEQ ID NO: 289660 - DNA, 4101 bp, Homo sapiens
acagcagctcgggggtgagcagagctagggctgggaaggtggagtgaggacgcagagacctagagccagtgtagatgatgtggcaacatggaggcagcccagccgtaggggccagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289661 - DNA, 3568 bp, Homo sapiens
ccatctgtatcacagacaggtgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289662 - DNA, 3617 bp, Homo sapiens
agctacaagttgttactacactggcacatattgcttgaacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289663 - DNA, 4528 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggtgagacattcattcttcacctttctcagcacagacaagtgttttagtctcttcttgctttcctgcccaagcccacgagagctctggagtcccccagagtcaaacagctataattgttactattaccgtaataataaaaaataagagcagctcacaggtactgttactgtgcacaggcacttttacacctgtgggaaaagattattttcgtcctcattttatagatgatgaaagtaaagcttcaagtcagttaaataatttgtcaagggttgcacacatttctaagtcccttctggctggcaccagtgcctggctcttaactggtattgtaagatgactcttcagtcctttcagtccttgtccagaaggattgaaggcctaaatatgccaagggacaggattcccaggcttaatccttcctttcccctgactggcaggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289664 - DNA, 4593 bp, Homo sapiens
ccgggcgaggggagtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccaaaaaaaaaaaaaaaaaaaaaaaaaaaaaaaaaaaaaaaaaaaaaaaaaaaaaaagccaaaaaacaaaaaacaaaaaaaacaacaaaaaaaaaaaaaacataggaagcagaagcgaaaacaaaaaaagacaaaagaaacatggaacaacacgagcgtggccgccggagaacaagggaaaagagacacggaggagatataacacaacggggcagcaacaacacaacgggggggaaacacagagaggaggcgcagacaaaaatgcacaaaaggggaagcagtcacgaaggaaacaaaagagggggagaaataaacaaggaggagacgacaaaggaagacagagaggacagaaataaacacgcaacagtggggaacagagagagacacaaagaaagcacacagagagggaaaaaaaa

SEQ ID NO: 289665 - DNA, 4068 bp, Homo sapiens
ccgggcgaggggagtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagcccctttttgaatacaaggttactttgggggtgtggtttggcaataagtggtttcctcgtagttctctaaaaactacaagttcttttggatcccatctaatcgttctacctattc

SEQ ID NO: 289666 - DNA, 3527 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatcatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 289667 - DNA, 1463 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggacccgcgcactgaggcgcaaactcatcccgatattgacagatgtactggtgttctccaggaaagacccaagaa

SEQ ID NO: 289668 - DNA, 838 bp, Homo sapiens
agcggggtgctgggatcccgggagggagcggagcggacctgggcttggtcgcctccaagccggcgggaccgagtgctttaggccgctcgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagaacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagttccagctcaagttctagggatcctctagatcacctcagcaa

SEQ ID NO: 289669 - DNA, 743 bp, Homo sapiens
atccgtggatttccgtagagttaacttaacatatgtattgggtggtctgtttgctgcccaattttttaagtggctgccttttatcacttctgctgatagtctcccatttgtggcattataaagcaggctaatgagaatttctggaactgacccgtcttcgagagactgacatgcggatgtactttcactacaagacatttctgacacgctcatttgggagtcacagacacattttatcttgtgaattgttccttgtactgtattctgaaccaagatctggaagccctccaacattttcaaaacagaactgcttattaatatagagaaaaagaagcagcatcaggataataaacacccaaacagctgacaaaaacccaactgcctctggagatacttttctaaaacagaggaaaagaagtgcagaaaggaagaactgggaagtgatgttggcccaggcagattctaaccctctaagttccacagtctacaagcaagagtgcattaaggcccacatagactgcattctctgtgattccagtgataacttaaggaaagcttcctgctgactcaaaaggatttttcttcttctgaactcctattatgggaatggatgaaatcacttacagagccacagaaggaaacaaagcaaagccaggatcatgagttggattatctggaggcctaggccaatggggagttattgcttgcagtcactgatcaagcaaataaacttttccttcttt

SEQ ID NO: 289670 - DNA, 539 bp, Homo sapiens
atccgtggatttccgtagagttaacttaacatatgtattgggtggtctgtttgctgcccaattttttaagtggctgccttttatcacttctgctgatagtctcccatttgtggcattataaagcaggctaatgagaatttctggaactgacccgtcttcgagagactgacatgcggatgtactttcactacaagacatttctgacacgctcatttgggagtcacagacacattttatcttgtgaattgttccttgtactgtattctgaaccaagatctggaagccctccaacattttcaaaacagaactgcttattaatatagagaaaaagaagcagcatcaggataataaacacccaaacagctgacaaaaacccaactgcctctggagatacttttctaaaacagatgcagaagatccagtgggcaatttcatttcataatcttgattggcacccacacccttgccccaacttctgactctttggactgtaccataaaaaggaaataaacctttactatattaaagcactgacattt

SEQ ID NO: 289671 - DNA, 447 bp, Homo sapiens
aatctgcccaactgaataaaccatttatgcctagtgttccattactggaacgctaagcttatgggagttatttagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccacta

SEQ ID NO: 289672 - DNA, 5416 bp, Homo sapiens
tcgaagtggacttccgggtcacggcggagctggctctcacgtggaggcggggaaatttcgcccaccggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaagctccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289673 - DNA, 5588 bp, Homo sapiens
gctaaagaggaggatgctatacttttctaaatggcaagagatggggagagaaggggattaagagttgacccgcaacctcccggtggattctttgttcttaccagatctcttggccactcccctattctgaagtcgtcttggctctcttgactgctcccctattctgaagtcgtcttggctctcttgactgctcccctattctgaagtcgtcttggctctcctgactacactatttcaaggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaagctccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289674 - DNA, 2003 bp, Homo sapiens
tcgaagtggacttccgggtcacggcggagctggctctcacgtggaggcggggaaatttcgcccaccggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccacta

SEQ ID NO: 289675 - DNA, 5017 bp, Homo sapiens
ctcccaaagtcccagctgcttcatctgtaagtgacagtaaggtcacccctgcaaagggcggggattcagtaagatgacgaagctctgtgcccacagatggtcattactcatgaaatggaagaaactcaccagtcagtgaggtcgaggaatgaagggtaccccagcagggacaagccttgctttaatgcaagtacagctgaaaactgaaaggcttcagctcacctctttcagatgtgtcctcaaactacccaaagctgcagtcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaagctccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289676 - DNA, 4710 bp, Homo sapiens
tagggaggtggggggaaatgcttagtgtagggtggtggggggagtgcgctgttgtgaagtgaggcacactgtgccgtgtgccatgagttaggaaaggaggaggaaggcagaaaggcagctctgtgcagaggtgggcagtggtgttggctggacctgggctggaattctgggggtcactagttaggtttctgtctccagctaagctgcagacctctattttctcctctgtgcaatgggaataacaacagtgtttctcatagggctgtctttaggattaacggaataatccgttgttgagcttattagcactgtgcctggtacacagcagccatctaatctgctgggccctccctgatgagggtgggggtcaagggaaggaaagggctttgaactcaaggaaaatagccacctttttcctctcctcacagggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaagctccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289677 - DNA, 4683 bp, Homo sapiens
gctaaagaggaggatgctatacttttctaaatggcaagagatggggagagaaggggattaagagttgacccgcaacctcccggtggattctttgttcttaccagatctcttggccactcccctattctgaagtcgtcttggctctcttgactgctcccctattctgaagtcgtcttggctctcttgactgctcccctattctgaagtcgtcttggctctcctgactacactatttcaaggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaaactctagagttttgtccccccaaaactgccacaattgctttgattattccatttatgctggagattacaaattttttttgtgaaaaaatcagatcttggtgaggacctcgagcagtaagatataaataactcccataagcttagcgttccagtaatggaacactaggcataaatggtttattcagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaagctccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289678 - DNA, 1383 bp, Homo sapiens
tcgaagtggacttccgggtcacggcggagctggctctcacgtggaggcggggaaatttcgcccaccggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaaaagaaggtagagcagccagtcatcgaggagccagctctgaaaaggaagaaaaagaagaagaggaaagagagtggggtagcaggagacccttggaaggaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacggtaagtttggggctagggctctgcgaggaggtggcacgctcggcctcccgacgcttcccctcgcctccagcatgaggagtggagcaggagaaccaagtatgtccaggccccagaggcagccctagcctgcagcaggctccctccacagcagaatttgtcctgagctaatttccttccttctgaaaagggcgcttgcctccctcctagagagctggcccggtgagataagctgcctgaacctttgtctca

SEQ ID NO: 289679 - DNA, 3860 bp, Homo sapiens
aatctgcccaactgaataaaccatttatgcctagtgttccattactggaacgctaagcttatgggagttatttagttgtgcaaatgaaagccatctgacagttggctcacattgaacacctgtggagattaaggacgaggacaactatattgatgggcttggatgaactggggcagggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaagctccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatgccaggaggagatgaacgtgtggagatgacacgggaagttgcctcatcggctgtggggacagcgtttccaagcctggactctacagcaagcctcaaagagctccaggtccagtggcccaagtcgcatgtgaccatctgtgaccaccttctttccactcacctagctttttgcatcccaaaatacaggttctgactgggacattttcacgatcgtttggcctgaacatgcctcctacagacatcccagcccaggcaggcctcgatggccagaaagttcagtctcacgtggcaggaaggcctgattagggcctggttcaacagctcgccaaggaagcattctctccatcatctccagtgttggcttcatcaaggctagtacaaagatggcagtaacagttccaggcagcatatcaagaccctagaacattccagaggaagaaaagcctttttgtgtctcaaggaaacttccagaagcctccattgctgggcaatgagtcatctgcccatagctgcacccgcccctgtcatgggaaggctggtgattcccttcagtcaagaagagtggatgctggtgaagtggccatggtgtccacagctgcccattgggcagaggtgaggcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289680 - DNA, 2020 bp, Homo sapiens
  misc_feature (28)..(29): n is a, c, g, or t
tgagacagtttcactcttgttgcccagnnggttcctgtttacagcaggcacttcaggcagtttccctggctctgaaccctgatccgcaagcattggccaggtcaatagttggacaagtatgtgctacaaggacctacttgggccacttccctcaggacgtgaacttgtcctgcctttctttcctggattcaaccttgagatacataatgggagaggccgtggaaagcccaagaggcagtgttctggatttgagtgagtgccttctgggcacctcctcctttgatggagaaacaaatccctcctgaccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289681 - DNA, 1782 bp, Homo sapiens
gtataaattgtcagatagaaatggattagccagatagtaacctacctagcgatttctctttcaaaacccttgagcaacactacaggaatgtgcctggtgtaaacaggaaccagccgttcgtttctttttttttgagatggagtctcacggtcgcgcaggctggagtgtggtggcgtgatctcggctcattgtaacctctgcttcctgggttcaagcgattcttgtgcctcagtctcctgagtagctggaatcggccgtttactactcatagtttttatcttgccaagaggtcaccctgacgttggcctgccttagctctgttaaaaaggttgtgctctgccaggtgcggtgactcacgcctgtaatcccagcactttgggaggccaaggtgggcggatcacgaggtcaagagttcgagaccagcctgaccaacatggtgaaaccccgtctctactaaaaatacaaaaattagctgggtgggtgtggtgtcacgggcttgtaatcccggctactcaggaggctgacaggagaatcgcttgaacccgggaggtggaggttgtagtgagctgggatggtgccactgcacactctagccccgggcaacagaatgagactctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289682 - DNA, 1227 bp, Homo sapiens
gatatacccgggagaggggacccagtacaacactaaaagtccgggaaaaaaataaaggctctgtctcaaaaacaaacaaaaaaaaactgtctttgggtgattgtggagaggtgatcatatgtccgctgtgttgctcccatccaagccctggtgactggtagctctcatgagggtgtgatggtcaggccttgcccctggtgtaaattctgtctgtaataggctgtgactttctaactcaacatcaccactggcttaggagttccatttgcacagggggagctttattgcttttctatatacataagaactttacgtctcaccagtggaggttgggcagccaagacaccacaatgctgggtgtcttcagaatggacttaatcttgtccttttgctttctgccagtgcagatcaccatctctcagatgagcaggaccccaccctctggcagtcttgtcttgggagaatcactctgagctcccatcctttgtaaattaacattggtttgagcaccaccctccatcacggctgcagtgagccatgattgcaccactgtgttccagcctgggtgacagagcaagaccccattccaaaaaaaaaaaaaaatttgccaaatagacacagtcctcacaaaagaagttggcagaataacaccccttcctaccacatctcctcagaacctgtgtatttgttaggttacgaaacaaaagggaattaagtttgctaatcagctgaccttaaaacaggaagaggatcccgtgtttctgggtgggccggaggaatcacaaagatccctaaatgtggaagaggaaggcaaaaaagagtccacatcaaagagacttaagaaagacttgactagacactgctggttttgaagatgggaagggaagggtcagaagccaaggaatgtgtgtgctgtctagaagctggaaaaggcaaggaagtagattctcccctagagcctcccagaaggagcgtagccctgctgatgccttaattttagctcagtgagaccaggcggacttaagacctatagaaccgtcagatgacaacattatgttttaagccgctacaattgtggcaatttgttaaagtaacaatagaagacctaatgtaagtctcatgtggaagttgccatggttttgtttttctttctttctttttttttttttgagacagtctcactctcactcccaccccaggctgggcaacaagagtgaaactgtctca

SEQ ID NO: 289683 - DNA, 541 bp, Homo sapiens
ccaagccctttccatgggttatctcatttactccctccaacacccttttgaggagggaggtgttatattcccccattttccagatggagaaattgaggctcagggaggttagctgatttacttaaggtgagagaggcatttaggtttgaacctagggctgtgtggatttaaaatttacgctgtttctgtagtatttctttttttgctttaaaggaatcatgtccattttccctgtcccacaacgctttgaccacccactcaaagaaacatggctcttggcaatgcttagtagaattgaacacaggatggcttggtatgggataacttgtaccatttgttttttcaggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtga

SEQ ID NO: 289684 - DNA, 925 bp, Homo sapiens
agagccgtcgctggactcatattaaacagtactgcgacagaacgaaaaagcaagataaaaatagtatggccggatcttttttaaaatgggaccactgcgcaagttacgcctgcgtattgcagggaaggaccgtaaaaggctgtggtgctgatcaacgaaggatttctcggagaaaattcctcctttgcggaaatgtccgtagaaacgcaccttttttttttcctgccaggacaaaccgccggcgatatccgttcatgtgaaagtgtttactaacattctctgaagactcactgggttctcagctcgagaacgttcctgtcacaagacgtttaggaggcaggatgccggtacaatgtatttatgttcttgtaaactgttgcattaacagtgcacttcaagtgggcacatttgtcgttggattttttaccaactcgagcttggactttaggacggggaaaagaagtgctaaatgtttttgaataaaacctttactgcacatgataaacatcccttaaaaattacctaggagcaccctaaattttaaaatgatcacaaagacctggacagattacagtaaaccttcaacatcgctaaacacacgtaccataaatcaaaagaaacacactgctaatgatccgttttttgatgtggaaatatcatgctgtttttaagggaaattatactttattgcgatgttttatttcaaaacaagatgttacactttatttcctataattttatttacaatattttacacccgttaagcaaaaatccccctacattgctattctgtttttttttaatcagttcactactgtagtatctttttgttctccatatatttttgaaaaatacgcaaaagagttctgcagaacttatcaggttggactctgtgaagcctgcaggccagaattgctaaggtgac

SEQ ID NO: 289685 - DNA, 2024 bp, Homo sapiens
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289686 - DNA, 1954 bp, Homo sapiens
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccaggcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289687 - DNA, 2542 bp, Homo sapiens
  misc_feature (2248)..(2248): n is a, c, g, or t
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaaaaaccaacaaaatcataaggcaaagaggaactgttggcaacggagtacggggttgtgggccatgaaatcctgggggggagtcccaaaggggggtggagaaagcaccaggggggaataggggaatggcctccgaaccactccgttttatgattgccccgtgcggggacacgcacaagggggggcccccaatgggaggtgccggcggaacatggacgataaccggnggcggaacccacgctctttatgtgttcgtcagcgtgcgcacacaggcacaacacctgtggtgtgtaggaggggggccccccaaaaaagaggttgggggggttaaatggccaaaaaacaacaagagaggaagaggaagacacacacactatctcttctagtaacaaacaacaacaagggtgtgtggacagacacatacactatatggtggcagcgggagcagcacacagaacaaagtagaatatctagtgacgtgcgtagtcgggactacacacaagtacgtagtagagtagaga

SEQ ID NO: 289688 - DNA, 2495 bp, Homo sapiens
  misc_feature (2138)..(2138): n is a, c, g, or t
  misc_feature (2392)..(2392): n is a, c, g, or t
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggggcgtcaggcagggaattctggtgacttcaggggcaaagaagtgggcaccgggtgggtctcccaactccactgcatcctcctggctgcgaccttggaccaagtgacaacctcccagaacttagttcctcacttggtgcccacctctcagagaagacatcgcacacacggccgggcacggtggctcacgcctgtaatcccggcactttgggaggccgaggcaggcagatcacctgaggtcacgagttcgagaccagcctggccaacatggtgaaacttcatctctactaaaaacacaaaaaattagccaggcatggtggtgggtgcctgtagtcccagttagttgggaggctgaggcaggagaatcatttgaaccctgaaggcggaggttgcggtgagttaagatcacatgcactcaaccctgggtgacagagcgagactccgtctcaataaataaataaaaaaacagacattgcacacaaagcctcagcccagcaggcactcggtcaatgctggaaacagacaggaggcagggacgttgggaaatgtaacagtggctgagacgcgctgaggagccaccgcaggccagtgagatggtgcggcgctaagcgctcacacgtgcaccatctcttagcacccaaagccacagagcagttaagccacctgcccaaggccacatcttgaagtaaggggaggaggagatggaatccccagtggtcagacatcagacatcaaagcctaggctgggtctactgcttgggaagcacgatggacccccagagggccttgaaggctgcccaaagtccccatctgggagacccaggccgtcatctcagcgagcaggctggagggtggaaaccacagtgaacctgggtggtcaagagtcagccccagaggcaggtgcaggagtttgagccaaatgtgcagagccccacgtcattcattcaaccagtatccactgggcccctgctacgggcaagtcctgctctaggtgctgggaacaccaacataaagaacagcaaacccctgaccccttagaacttgcattctggtaggagagagaaaacagatagggctggacacagcggtcatgcctataaatcccagcacttcgggaggctgaggcgggaggatcctttgagcctctgagtttgaggccagcctgggcaacatagcaagacctctctctctncaaaaactttttttttttttttttgagacagagtatcactgtcactcaggctggagtgcagtggcgccatctcggctcactgcaacctccacctcctgggttcaagcgattctcgtgcctcagccttccaagtagctgggattacaggcacacgccaccatgtccagcctctataaaaacatttaaaattagccaggcatggtggtggatgccctagagtcccactgacttgggaggctgaggtgggaagatcncttgagcctgggaggtcaaggttgcaatgagccatggttgctgcagtgagctgtggtcgtgccactgcactcaagcctgggcaacagagcaagaccccatctc

SEQ ID NO: 289689 - DNA, 825 bp, Homo sapiens
tctgttgatggacacttagatttcttccaaatcttggctgttgtgaacagtggcgcaataaatatggcagtgcaggtatctcttcgaggtacaaaattcctttctttggggtatatacccggcagtgggattgctggatcatatggtagctcaatttttagttttgtgaggaacctccaaaccattttccatagtgggtgtagtaatttatgttcccaccagtagggtacaagggttcccttttcttcacatccttgccagcatttgttatttatatcacagttcaaaaaaataatgtaatataccaaaaacgattgagttgtggggaaaaaaaaatataagtgcactagaatttatgcaactgaacaggaactgtctagtttgttgtcttttttttttttttttttgagacagggtgtcattctgtcacccaggctgcagttcagtggcgtgatctcggctcactgcaacctccacctcccgggttcaagcgtcagcctcccgagtatctgggatttacaggcgcagccgtgcattgaaagtaatggtaaaaaccacaattacttttgtgccaacctaataccatcccacaccagtgtcccacagtcacacccccccttgtggttaaactttctctcagcagctgttgaaaagtttttcctctctccgataattctgctgatggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289690 - DNA, 1878 bp, Homo sapiens
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggaccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289691 - DNA, 381 bp, Homo sapiens
cctagaagactacttgagttattcagctctgccggtggcctgcgcgcgcccttgtgactcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289692 - DNA, 179 bp, Homo sapiens
aaagcaattagctgggtctttcttccagatccagcatcttccaggtaccagaacttcagcaaaggtaggtaggctcctggagaaagggggaggccatggtgggggccacacccaggggctcaggcccaattctcgcctcctcccgcaggaagcagacacgggtcggaggaagcctacat

SEQ ID NO: 289693 - DNA, 1835 bp, Homo sapiens
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289694 - DNA, 1779 bp, Homo sapiens
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289695 - DNA, 2097 bp, Homo sapiens
ctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcagagatggaatttcaccgtgttgcctaggctggtctggagctcttgatctcaagcgatcctccctgcctcggcctcccaacgtgctgggattataggcgtgagccaccgctcctggccagggtctgttcctagttgcaacagttcttggaaacccactcgagagggccacgcctccattcaccaggccacgcatcacaagaggcaacaccaggagccaacatgagctcggggactgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattctaccccagcctggaggatccagcatcttccaggtaccagaacttcagcaaaggaagcagacacgggtcggaggaagcctacatagaccccattgccatggagtattacaactgggggcggttctcgaagcccccagaagatgatgatgccaattcctacgagaatgtgctcatttgcaagcagaaaaccacagagacaggtgcccagcaggagggcataggtggcctctgcagaggggacctcagcctgtcactggccctgaagactggccccacttctggtctctgtccctctgcctccccggaagaagatgaggaatctgaggattatcagaactcagcatccatccatcagtggcgcgagtccaggaaggtcatggggcaactccagagagaagcatcccctggcccggtgggaagcccagacgaggaggacggggaaccggattacgtgaatggggaggtggcagccacagaagcctagggcagaccaagaagaaaggagccaaggcaaagagggaccactgtgctcatggacccatcgctgccttccaaggaccatttcccagagctactcaacttttaagcccctgccatggttgctcctggaaggagaaccagccaccctgaggaccacctggccatgcgtgcacagcctgggaaaagacagttactcacgggagctgcaggcccgtcaccaagccctctcccgacccaggctttgtggggcaggcacctggtaccaagggtaacccggctcctggtatggacggatgcgcaggatttaggataagctgtcacccagtccccataacaaaaccactgtccaacactggtatctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaagcagtgattatcctgtgtctcctttctcctgcttcaggtaaaaaaccttttataaaaatataaaaattagccg

SEQ ID NO: 289696 - DNA, 1649 bp, Homo sapiens
  misc_feature (153)..(153): n is a, c, g, or t
tttcatcctgcgctacgctgtctatactcgttcgtcttctgcttgctgttcgctctgtctgtcgtgtgtgtcctccttcgttctgctgtcgtctatgtctctgtcgctctgcatctatcctcgcttcattgttgctccctctcttctgtctcnctgtcctccgtattcttcgtctcgtcttcttgtttcgtctgcttctcttcgtcgttcgtgtctgttcttccgtctgcttttccttgtctgtttttgcgctgcttcgctcgtctctcgtctctttctctttcgtggtctgcctgctgtctctcttcgtcgtcttctcttcgctttctgcgcctctgtgttcctctgtcctctttctcctgccccatctctccttgcgccggtcttcctatgctctcttcctctctgctctctctcctctctctgtctcctcgttcgcgctcgtcctgtttggtgcttggtctcgtccagcttgtttcttctcctcttctctccttccttcgtttttctttctgttggtttcattgctgttctttgtgttgtttttcgtttttcgttgcggtgtgttctggttctgtttgtgtctttgctgttcgttgtgtgtgcgtggttggtgttatgtgttctggagtcggctctgactggctgcgcgctgtggtcgtgttgtgtgttgtgttctgggcttggtgtgctatgttggttcgttgtctcgtgtgcgtgttcgttttgtttgtgtgatgcgtcgtcggtccggtgtggcgtcgtgttgtgtcttgttttcctcgttctgtgcttgtttcgtttgttttgttgttttctcggcgcggctgggtcgtgagtgtggcgcggtctgtggtgccgttggttttggtctcgtgcttgatgcgcgtgcgcgtgctgcttcgtctctcgacgggtggcggttgttcgcgtctctgtgtctctctgattgtgttgtgcgagccacgcctcctctggtgttctttgtgttgtttttttctgttttttgttgttttttttgcttttttttttttttttttttttttttttttttttctttttttttttttttttttttttttttttttttttttttttctgtgttcttttgtgctatgaatttggattcctaattgctattgttggttgctggggttttaaatgattgataagcttgtacagttaacttatagagggggagccatatttaacattctggatttcagagtagagatttctgtgttgtctcctagaaagcattacatgtagtttatttcagcatccttgttgggtggggccctggctctcttcccctttggtgggacctcccctttctttgggcttcagttcactcaggaagaaatgaggctgtcgccatctttatgtgcttccagtggaaatgtcacttgctacagacaatagtgcatgagagtctagagaagtagtgaccagaacagggcagagtaggtcccctccatggccctgaatcctcctctgctccagggctggcctctgcagagctgattaaacagtgttgtgactgtctcatgggaagagctggggcccagagggaccttgagtcagaaatgttgccagaaaaagtatctcctccaaccaaaacatctcaataaaaccattttagttgaaaa

SEQ ID NO: 289697 - DNA, 1947 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttg

SEQ ID NO: 289698 - DNA, 399 bp, Homo sapiens
ctgtcttcagccagtgcctgtctcatatgtgggcgggactctgagcagcctggcagcgagggtatgtataaaatgcttggcctgcaccagggctagggagaggacgacaccaagcgccggcactttgggtggctccttgggtggctcgttgggtggctcctcgggtggcacctggagtggctcgttgcgtggcacatcgggaggctcatcgggtggcccttcgtgtggctccgtcgggggaacaatcacacctgtacatggaaggctcgtggtgtgggaggatacccttgacaaatactgtgaccgggagtatgctgtgaagacccaccaccacttgtgtccccacgagccacgcgagagacactgatcgagccacccgaagagtccggacggacagat

SEQ ID NO: 289699 - DNA, 2552 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 289700 - DNA, 2710 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtcactttgccatcttgaatttattcacatattttgaaaggagtgccaccttgttagctagctatcaggactcaaagaagatatggttcttggccttggtgagcccccaaaatgccacagcccagcctaacatttttaaagcttcacttttgatccttagaa

SEQ ID NO: 289701 - DNA, 2322 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttg

SEQ ID NO: 289702 - DNA, 2350 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttgaagcagttgacctgttcatccgtcgacg

SEQ ID NO: 289703 - DNA, 2016 bp, Homo sapiens
tcccaaggaacgtgtgtccccttggaagaaagggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 289704 - DNA, 2843 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggccgtaagtgggcgtcccagcctccctgagagcctgtttgcctgcctgcccatcttcgacctctgatcctgccagtccatccatccatgtaccccccctgctgtgagtgcgtccacccgttcatctgcttgtggctgtccgtccatccattgtgtttgtcacctgagtttgttcatcttgagcttcgtactacacttctggcctcctccactcatgatccacacacgcatctgtctaccatccatccatccgtccagctctggcctcacctgaccttctccatccactgttccagctcatctcccggcaccagcttggaacctcatccaggcttccacccgtccaccttcccaagcccacacatcaacagttgcctcctaaccctctacttttttgccattccctttgggcctctcgggctgggagcccctcatctagttgccagggacgataagggaagtcgatggtcaggagagaaggggccaagtgtccagcttctgacttccctctctctggtccacagttgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttg

SEQ ID NO: 289705 - DNA, 2636 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaaggtggaaaggagggaagaggccctcgcccccactcccagccctggctaggagaaagggtgggctgctcacacattcccccttctatgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 289706 - DNA, 2708 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaaggtaaggtcaccatcccatgccctcctcagtgaccctccaggtttctaatctggcctatatcccacttttcaggtggaaaggagggaagaggccctcgcccccactcccagccctggctaggagaaagggtgggctgctcacacattcccccttctatgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 289707 - DNA, 2427 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaaggtaaggtcaccatcccatgccctcctcagtgaccctccaggtttctaatctggcctatatcccacttttcaggtggaaaggagggaagaggccctcgcccccactcccagccctggctaggagaaagggtgggctgctcacacattcccccttctacctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttggtgtcctcattgtctatctaatgtctcacccgcagtgttttaagtggatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 289708 - DNA, 1744 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggagataccctgacaatactgtgaccgggatatccttgatatggaggcttac

SEQ ID NO: 289709 - DNA, 665 bp, Homo sapiens
caggattccgtcgatactcagatcatggaaggctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttggatttg

SEQ ID NO: 289710 - DNA, 1316 bp, Homo sapiens
gctgctggtcatatgtcttcatctctgactctggagaggtgggataaaaggatgttccactttgtctccctcttttttgtcccagagagttagggaaattgaaaagggacagtccagacctcacactggtaggggagatcccttggataggtttcctgctccccgctgtaaactcctttgtgccctgtttccccaaccccagttcatgagttggcagatcccctctccacagaaggcagcctgtagatggagaaactgaggcacaaactaggggctcaaacacctcttgctcctggattctctgaatcagtttctcttgaaggtcataagaatgttctcctctaatcagtcccattcttctcaatcctctgaggaggcttcagggtgactttgggaggagtggcttccagaggaggagcagctgggactgagtcatggcaggaagctgaggagggcgggagatcacaccagacaattataaaagaagagctggtcctgaagctcacaaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatcttggtgccctggcccaggagggcactggcgttttcagacacaccacagacaaacacaccctcctaagcctgcttgtatttccttcagtgcctggcccctgaggcccacggccctgcccccttcactgagcagatgttcacaggctgtgggatgcgaccataactaaacagcttgacgtca

SEQ ID NO: 289711 - DNA, 530 bp, Homo sapiens
cacctctgtcagagtaaggatcttttcttctccacattccaatacctttgaaaacacacggggggaggaaagggaaaataaacaaatcacgggtgtttacagaatagcaaaaaaagtatgcagctagtaatgaaaaaacaagtcagcgttactgaatgggtataaagtttcagttgtgtaagatgaaaaagttcagaagatcggttgcataacaatgtgaatgtgctgaccactactggacaggagatataaagatagttacgaaggagcaccgtttaagaaccagataatagaaggaggatacgaccatacagtcaccccttggtgttctcaagggatcgggtccaggaccctgcctggataccaaaatccgcacctactcaagtcttgcggtctgccccgcggaaactgcagacacgaaaaattggcccccagtatccatgagtttcgcatccctcaaatactgtactttctacccgtaactggacctgtgcagttctgacttcaactattaaaatttgaaaggcaaa

SEQ ID NO: 289712 - DNA, 634 bp, Homo sapiens
ctaaaatggaataataatgaaaggtcatttgttgtttttgggttaatgagtcaatgtggttagaacatccctgaagtaagtgctcaataaacactggctattgttgatactgttaactattattatcaacagccaggtttgggcaccatgtgataagatgacctgcaggtctggccttggatttctgcagaggtttgttgggaaggcatcacttaggaggctggcagaccatgagaaagtctcacctggaagcggtggaagtcctgcggcttgaagtcattgggggagcagccgcaccagtccacgatgtgcttgtactggcacttgcagcccagcttgcgattccagttggtgatgcgcaggttgttgtccaccatggtgtcgcagtgggggctgttctccaggaccgtatggaagaaggactgcaggggagagagggacccagcctgagacctctcccagcctcccacagatgaactggggtgggaaatggtgaacccttgctctgagttcatgtaagaactggttgtttaaaagaatgtggcatctcatcagaagctgggcggcttcctgtacagcttgcagaactgcaagccaaataaacctcttttctttataaattaaaaaaaaaaga

SEQ ID NO: 289713 - DNA, 932 bp, Homo sapiens
gtgtttccggcttttgaagttatgtctgccgaaaaccacatctggttcaccgccgcctcaacagacacacaatgaaatacaaaaggctaattctgctgtgtacgcaatccatgtttctttccccagaggattccagatggagtgaactcagtagaggcggtgcttcgacggctgatgatcttgcggagaggagagaggagcattagttacggttttaagtcccggctgaactggcaggggttacatgacctcagactcagggacttgtaaaggatgtgcatgcttctcctttgccttccaccgtgattgtaagtttcctgaggccttcccagtcaatgcagaagcggctcaccggcagctgttctccccatccgtgtgcagggacgtctcggcccgtcgaagacccaggcgggcaaaggagtggtacaagccaggtttgggcaccatgtgataagatgacctgcaggtctggccttggatttctgcagaggtttgttgggaaggcatcacttaggaggctggcagaccatgagaaagtctcacctggaagcggtggaagtcctgcggcttgaagtcattgggggagcagccgcaccagtccacgatgtgcttgtactggcacttgcagcccagcttgcgattccagttggtgatgcgcaggttgttgtccaccatggtgtcgcagtgggggctgttctccaggaccgtatggaagaaggactgcaggggagagagggacccagcctgagacctctcccagcctcccacagatgaactggggtgggaaatggtgaacccttgctctgagttcatgtaagaactggttgtttaaaagaatgtggcatctcatcagaagctgggcggcttcctgtacagcttgcagaactgcaagccaaataaacctcttttctttataaattaaaaaaaaaaga

SEQ ID NO: 289714 - DNA, 731 bp, Homo sapiens
gtgtttccggcttttgaagttatgtctgccgaaaaccacatctggttcaccgccgcctcaacagacacacaatgaaatacaaaaggctaattctgctgtgtacgcaatccatgtttctttccccagaggattccagatggagtgaactcagtagaggcggtgcttcgacggctgatgatcttgcggagaggagagaggagcattagttacggttttaagtcccggctgaactggcaggggttacatgacctcagactcagggccttgttaaggatgtgcatgcttctcctttgccttccaccgtgattgtaagtttcctgaggccttcccagcaatgcagaaccgtaagtcaattaaacctctttcctttatacgttatccagtctctgggaagttctttatggcaatgtgaaaaatggcctaatataatacatacttgtttctcttgggtataactctaagattgaaactggggtcttatttaattttattgggaactggcaaattgtgttccagagtaattgagttactctgtattttatattcccattagcattgtgtgggagttccagtcactctacatccttgccaatacgtctattattcttttttattccatcccagtctacaggaaaactggatgcttattttctccatcagagttttccgccatgttgtactttctgccatattgtatatatgttgctgttcctactggggacatatacacc

SEQ ID NO: 289715 - DNA, 1042 bp, Homo sapiens
cgtcaaataaacgaatgagtggaaaaattcttaatcctgtccccaggaaaagccgaggttgcaggtgcctcatgaggctgaccttgcttttggaaccagagagagcagtcaccgtgccagcctgtgagagtgaagtctctgccgatccctaagagaagagccaacgtttcactctaaacgcatgctccttctgctttaccggtcattctcaagtctgactacaaattagaatcatctggggcgtttaaacacagaggcctgagccctgcctcagacagaataaatcaaagtctccaggagctgtgcccatgaactctttttttcctttttaaagctccccaggtgattctaaagtcagccaggattgagaaccactatgccacactgttgcttttgttcaaggtaactaaatgggctcttaaatgtgtcagctgtaaatgattaaacttgcagtataaatgcttattactgccacattgtaattatattcacgatgatttccactcgcgctctctcagttggatgtcttttaaatgaaagactgcaagtcttttacatctttataaaacagaactagcaaaccaaaaacaacatttgccaactgaggagaaacaagagttgtgaaattctgggggtggtgttgctttagtgtggcaaacagaactactcataaattatccctgctcaagtgctgggtccaagaagaatttcagtctctctctactctgcacctgtgttcaggctgtatttcttggcaattgtcaccttataaattctaccaaatgtataattgtataagaactgtggtataaaaagcaatttgtttctagtgggaaaccttagaactgggcctaaagcaaaataaagtgaattttgtcctaaggcagacagccccagtagagaattactgcctccaaactttcagcctcctggaatagccttggcatgtcaaatttcatttagttcatgatgtaagagacattttattcaaagttagaagaactacttagagcaaaagtaaataaaaactatttgtcatcta

SEQ ID NO: 289716 - DNA, 1953 bp, Homo sapiens
ccgcgttgggggggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagaaaagccgaggttgcaggtgcctcatgaggctgaccttgcttttggaaccagagagagcagtcaccgtgccagcctgtgagagtgaagtctctgccgatccctaagagaagagccaacgtttcactctaaacgcatgctccttctgctttaccggtcattctcaagtctgactacaaattagaatcatctggggcgtttaaacacagaggcctgagccctgcctcagacagaataaatcaaagtctccaggagctgtgcccatgaactctttttttcctttttaaagctccccaggtgattctaaagtcagccaggattgagaaccactatgccacactgttgcttttgttcaaggtaactaaatgggctcttaaatgtgtcagctgtaaatgattaaacttgcagtataaatgcttattactgccacattgtaattatattcacgatgatttccactcgcgctctctcagttggatgtcttttaaatgaaagactgcaagtcttttacatctttataaaacagaactagcaaaccaaaaacaacatttgccaactgaggagaaacaagagttgtgaaattctgggggtggtgttgctttagtgtggcaaacagaactactcataaattatccctgctcaagtgctgggtccaagaagaatttcagtctctctctactctgcacctgtgttcaggctgtatttcttggcaattgtcaccttataaattctaccaaatgtataattgtataagaactgtggtataaaaagcaatttgtttctagtgggaaaccttagaactgggcctaaagcaaaataaagtgaattttgtcctaaggcagacagccccagtagagaattactgcctccaaactttcagcctcctggaatagccttggcatgtcaaatttcatttagttcatgatgtaagagacattttattcaaagttagaagaactacttagagcaaaagtaaataaaaactatttgtcatcta

SEQ ID NO: 289717 - DNA, 1128 bp, Homo sapiens
ccgcgttgggggggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcaga

SEQ ID NO: 289718 - DNA, 2092 bp, Homo sapiens
ccgcgttgggggggacactggggctgggggggtttgttgggctggtgagttttcgaggtgactgtgctgtgctcggtgaggggacgcccagagagccctgacccggggtcactccgtcgccgttctcctcttgtctacgtgctggacccgggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagaaaagccgaggttgcaggtgcctcatgaggctgaccttgcttttggaaccagagagagcagtcaccgtgccagcctgtgagagtgaagtctctgccgatccctaagagaagagccaacgtttcactctaaacgcatgctccttctgctttaccggtcattctcaagtctgactacaaattagaatcatctggggcgtttaaacacagaggcctgagccctgcctcagacagaataaatcaaagtctccaggagctgtgcccatgaactctttttttcctttttaaagctccccaggtgattctaaagtcagccaggattgagaaccactatgccacactgttgcttttgttcaaggtaactaaatgggctcttaaatgtgtcagctgtaaatgattaaacttgcagtataaatgcttattactgccacattgtaattatattcacgatgatttccactcgcgctctctcagttggatgtcttttaaatgaaagactgcaagtcttttacatctttataaaacagaactagcaaaccaaaaacaacatttgccaactgaggagaaacaagagttgtgaaattctgggggtggtgttgctttagtgtggcaaacagaactactcataaattatccctgctcaagtgctgggtccaagaagaatttcagtctctctctactctgcacctgtgttcaggctgtatttcttggcaattgtcaccttataaattctaccaaatgtataattgtataagaactgtggtataaaaagcaatttgtttctagtgggaaaccttagaactgggcctaaagcaaaataaagtgaattttgtcctaaggcagacagccccagtagagaattactgcctccaaactttcagcctcctggaatagccttggcatgtcaaatttcatttagttcatgatgtaagagacattttattcaaagttagaagaactacttagagcaaaagtaaataaaaactatttgtcatcta

SEQ ID NO: 289719 - DNA, 857 bp, Homo sapiens
gggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagaggcaagttgctttgttgtctgtgtcagttagcgtcttactccaggtgggctgctataacagactg

SEQ ID NO: 289720 - DNA, 1076 bp, Homo sapiens
ccgcgttgggggggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagaactgtgctaagcactattcgtttcttcattcattcaagatatatttattgagtgcctcctgtgtttcagacactgcttaggtgcagtggatactgcagcgaacagaatggaatacag

SEQ ID NO: 289721 - DNA, 2147 bp, Homo sapiens
gggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagaaaagccgaggttgcaggtgcctcatgaggctgaccttgcttttggaaccagagagagcagtcaccgtgccagcctgtgagagtgaagtctctgccgatccctaagagaagagccaacgtttcactctaaacgcatgctccttctgctttaccggtcattctcaagtctgactacaaattagaatcatctggggcgtttaaacacagaggcctgagccctgcctcagacagaataaatcaaagtctccaggagctgtgcccatgaactctttttttcctttttaaagctccccaggtgattctaaagtcagccaggattgagaaccactatgccacactgttgcttttgttcaaggtaactaaatgggctcttaaatgtgtcagctgtaaatgattaaacttgcagtataaatgcttattactgccacattgtaattatattcacgatgatttccactcgcgctctctcagttggatgtcttttaaatgaaagactgcaagtcttttacatctttataaaacagaactagcaaaccaaaaacaacatttgccaactgaggagaaacaagagttgtgaaattctgggggtggtgttgctttagtgtggcaaacagaactactcataaattatccctgctcaagtgctgggtccaagaagaatttcagtctctctctactctgcacctgtgttcaggctgtatttcttggcaattgtcaccttataaattctaccaaatgtataattgtataagaactgtggtataaaaagcaatttgtttctagtgggaaaccttagaactgggcctaaagcaaaataaagtgaattttgtcctaaggcagacagccccagtagagaattactgcctccaaactttcagcctcctggaatagccttggcatgtcaaatttcatttagttcatgatgtaagagacattttattcaaagttagaagaactacttagagcaaaagtaaataaaaactatttgtcatcta

SEQ ID NO: 289722 - DNA, 1482 bp, Homo sapiens
gcaagaggagaggcataaatttaggatctcacccttcattccacagacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgttgataggtcaggaaatgttcatcaccagtttcaaaagcttctgactgaattcaacaaatccactgatgcatatgagctgaagatcgccaacaagctcttcggagaaaagacgtatcaatttttacaggaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaaggatgtacaggccaaggtcctggaaataccatacaaaggcaaagatctaagcatgattgtgctgctgccaaatgaaatcgatggtctgcagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatagatgcaattagtctgtcactccatttagaaaatgttcacctagaggtgttctggtaaactgattgctggcaacaacagattctcttggctcatatttcttttctatctcatcttgatgatgatagtcatcatcaagaatttaatgattaaaatagcatgcctttctctctttctcttaataagcccacatataaatgtacttttccttccagaaaaatttcccttgaggaaaaatgtccaagataagatgaatca

SEQ ID NO: 289723 - DNA, 1416 bp, Homo sapiens
gcaagaggagaggcataaatttaggatctcacccttcattccacagacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaagaatacatacaaatctgtacagatgatgaggcaatacaattcctttaattttgccttgctggaggatgtacaggccaaggtcctggaaataccatacaaaggcaaagatctaagcatgattgtgctgctgccaaatgaaatcgatggtctgcagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatagatgcaattagtctgtcactccatttagaaaatgttcacctagaggtgttctggtaaactgattgctggcaacaacagattctcttggctcatatttcttttctatctcatcttgatgatgatagtcatcatcaagaatttaatgattaaaatagcatgcctttctctctttctcttaataagcccacatataaatgtacttttccttccagaaaaatttcccttgaggaaaaatgtccaagataagatgaatca

SEQ ID NO: 289724 - DNA, 432 bp, Homo sapiens
  misc_feature (19)..(19): n is a, c, g, or t
  misc_feature (21)..(23): n is a, c, g, or t
  misc_feature (46)..(46): n is a, c, g, or t
atatttgagtgtttttatntnnnaacgattatattagtgtgatggngtggaaagtaagtggtattagtttgaggaaaaagaatcttcaggcctctgctcttgtgagagtaatttctcttaacaccgacagtgcagcaatacaactaccaccacctttcaattattgagaggcaatcatctaaagcatttggcaagtgatccacttacggagccaagctaagggagctgaagagaagaggccgccgccccaacccagagctgcttgacagggttgtctggggaatacaaccttaccctgtcaaatgcctttcaatgtttttcttctccttccttacccccgtttcatcgtgtacctgcaatgggactctatttctgtaaaagcaagataaaggaacacaaaatgtactctttccctaattggataaagtgaga

SEQ ID NO: 289725 - DNA, 827 bp, Homo sapiens
  misc_feature (121)..(121): n is a, c, g, or t
cgttgggtttctctaacgacagtcttgggaaatgagtcagtagggaggttcgtcctctcccctctctaaagtaagggctgcggagtatccatttctgtggccaccgagccgcatttttttntttttgtatgaataggatttttattaatggtatctggtctgtggctacaatgttatattttgctgtgcttgacagattttttaccattgagatgtttatggaagaaagtttgaatttgctgccaggcatctacctgtgcctttgagtgagcctttggctcacctccatagaatattgcctcacccaaaacagcgtgcacagaagctctagaaggaggaaaataaggtgggtcaatacagtgaccagtttctgggtaacagattatctggggtctttctttcccatgagcttgtagcctttcagaggctatctgagcatagaattcactcttccagctttgatcatccatgccaacaataaacaagaagggcacctgcgccttttccaatggaacaagactttggtgattgtgttcctccagtggattgctccaagtgtccataaaagtgagaaatcctgacttagtgatttttacttttcctagatcatcgacaagtttaggaataatcatatccttgtaatgtagaggagctactgtgttggctacacaggcattgataagtacagtggctgtgatgcccttcaagaaagaagccattgagagacacaggtcacctcctttggaaaatccaagaagcgcaatactaggacgttcacgtcaagggtgttggtgtggggggtcgtctgtaatgcgtgtggaagggtg

SEQ ID NO: 289726 - DNA, 872 bp, Homo sapiens
  misc_feature (121)..(121): n is a, c, g, or t
cgttgggtttctctaacgacagtcttgggaaatgagtcagtagggaggttcgtcctctcccctctctaaagtaagggctgcggagtatccatttctgtggccaccgagccgcatttttttntttttgtatgaataggatttttattaatggtatctggtctgtggctacaatgttatattttgctgtgcttgacagattttttaccattgagatgtttatggaagaaagtttgaatttgctgccaggcatctacctgtgcctttgagtgagcctttggctcacctccatagaatattgcctcacccaaaacagcgtgcacagaagctctagaaggaggaaaataaggtgatcaccagaacgcacctttggatgctgcagcataaagtccacggcttcttcaaagtactccagatgtacatcattcagatcttcggggaggtcttcaaatctgaaataagccagggcaagcacagcaaaaccatgtccggccaggaggctggccctgtattcacaaaggcccctgctgctcccaaacagatcaatgatcccaggaaagggccccctgcctggagaacatcacaaatcacagggagctttagtttctcaaaagacagtaagcaaacaagtttttgaagccaaggagattgggggtagagagattggcagagaaagaacaaaatgtcttattttctcaaacaataatgataatatagagggataaaaaactacatattgggtacaatgtatactactcaggcgacaggtgcactaaaatctcagcgttcatcactgtacagttcatccgtgtaaccccaaaccacctgtacaccaaaaggtattgaaattaaaaaaaaaatttttttttgacagt

SEQ ID NO: 289727 - DNA, 823 bp, Homo sapiens
tgaggaatgcagctgggaggctgccagcaaatgccaaggggcctctgggtcccaggctagcaccccacagcaccccacaggggcaggcaggcctccagaggctctcctggaatccaaaaagccacttcctcgctaagcctccggtttcccgtctgcaaagtggcgatgatcattcctgctgcccttcctgactgagctgtctgaggacccagggttccaggggcaggtctcccaggatgagattttgctttctcttgaaacccatgcgttcctagaatctgttctgtgtttcattgtaggaggctctggccaggcctgggtgtggcaggatagaaatgaaagttgtcctggcaacacacaagatttcatcaacatttccatccccagcagctcctgggccaagcctcatcttgcccagtgtggcctgtcaagatgacggcctggaagagaagccagactgggcagccaggcctctgcccctccccttgcctggtggcacagccagcactggctcactgggaaagctcacaactcctcacagcgatctggtatcttgagcgtcagtttctggccgaaactgggggctcctgactgaactccctcccacctagaaaaccttctgtgcagtctgattgctccaacacccacagagcaggattcaggtatcccggagaccttgggaggtccccatccagaggtctgctgtcctgccaggcttggggcagcagggactgggaccccactcagacctctctggggcaaatgttttggttctcacaacagccctagtgaaatcaatcctagatactcccatttggtccca

SEQ ID NO: 289728 - DNA, 479 bp, Homo sapiens
attgcaggcaggtaacaagaagagagaattcatcctcctgtgagtggtaggcacccaggactgacctgcatgaaactgcaggcctacccaaccctttgtgtctgctgagagaagtctgccatggaccacacaccacctgacgtgaggggcacaggacaccacttctaaagtctcctaaacaaggtccctgaatagcaagccagaccaaggacaagtctagtgtgcccgagtgacacctccaggagtttgaagataaggcacatcactcactgtgacagttgggggatctcatagccagactggatattggagatgccagcagctactgcagcagtgaccatcagcctgggcttgttgatctgcttggcctcctgctcaaaagcttcacgcatttcctacagaataataaggcataataggacatctatgatgctgattttagctccttaaataatactaataaacatatgtctgtataa

SEQ ID NO: 289729 - DNA, 1637 bp, Homo sapiens
aacaacagccctgctctggtccctccaaaagccgacgaatccacacaagactaaagatgaagaagaggacaacaagcccagctctaatcacactccagaagataactagtctacgcacagccaaaacttaaaaactcatcagtctttcccagagacagattgaacttcaaggtaaaagtgaattttcagatgcggacaagctaacttctaaggattatgagtaattcgactcatcttttaaatatccagaaaacctcatttttagtgaaagagtggagataaaagaatattaagagtccagaaactggtgttctggctgtggccctgccttagactgtctcactttgtagtcactttatgcaggaaacgtgcccgggcatcttgaaatggatgagttctcttctggagatatgtctcatgtgtacgcatatctggagatatgcctcttgtgggtgctgctgcagctgctgtgcccatctcatatcaatacccaagcttttctcatgacgaaccagatgactcttggtaaccaggtttgctccccagcttctaatttcaatatgatgagaagttacataacatttactcctttgtaaaggtttctctgtcatcagacaaaactctgaatagaaaccggtgggtaatccagtgtactggtttttcctaatgtatttggtactatagtgtatgaaccgagaataatcgagtcaagtgaaacccccttttccagtcataaaatgtctcattcattatactaaaaggagctgttcttttaaaaaagccttcttatttttctactaaatttttagataagtataacctactatattcctcaaatctaggcttacatttgagaagggtaagctgtgttttttcctccgaagagttgggctgtgatctttacaacgagacgtcgtttttcccagcatatttctgttttctacctaaacattaagatacacatttttctaggcattagaaatagtacaatattgcctgtggtctttccatttgacacctgtggctggaatatatgtgtcgctccagaatttatatgttggaatttaaatgcccctgtgtgatagaattaaaaagtggggactttgggaggaggttaagagtgcaattagagaccttataaaagaactcaatggaagtagctaggctttttagcccttccaccattagaggacactgtatttgtcctctctggagaacacagcaacaaggtgccatcttggaagaagagacccaccttcaccagacattggacctattagtgccttgatcttggacttcccagtgtctaaaactgtaagaaatttatttctttccagtttcataagttacccagtccaaggtactgtgttatagcatcaggaacatactgagatggcatatttattgtggaaattttggtcctcatacttaatgaatgggcttcaagtatttcgttagtttttaaaaacagggctcctcctttacaattgatctcatttttattttttaaaagttagcttttacaacatagaactggaaaaaatctctactcagacctctagagtgtcctagattttgtggcagaatcactatggataatttataggtgcttgtgatctcatctgtgtattatttac

SEQ ID NO: 289730 - DNA, 328 bp, Homo sapiens
tgtctttagcggcaaaggggaactataaagacatatctaaagaaaaatggcttaacataatcgtttatgttaaatgatttagttttcatcagaattcaataaaatttggataaatctgcaccaaatttagttagatcatgaaacgctgagagatcacttcctgttctacctgcttgacttacggaacattttcacagtaactattaataagacacaactaattttctaatacctcactttcaattgagagattacttaaatgctcacttaacccatgggaatctcaatatagatgaaaaaacaagacttgcccaatctagttcagaaa

SEQ ID NO: 289731 - DNA, 1164 bp, Homo sapiens
ctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatg

SEQ ID NO: 289732 - DNA, 902 bp, Homo sapiens
ctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaagatcgtcgtctaaaaaacatttgtttctatgataacgttcccagttaagacgcttgctggcatcatctgggactcgggtgctgcctctatcaaggactgccaggtatttgtggagttagggatcacaaagccaaactcgaagaaccattcttctagcattgccctttgaagtaaactttttgttccaggaggaatttttccatttgttctgtcgaagaaaaattaagttctcgag

SEQ ID NO: 289733 - DNA, 748 bp, Homo sapiens
ctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactacagtaaaccggaaactggagaattgagagatttcagaagcaacgttttcatctgattggaaataccgtattgctgaaaagaagaaaggcctttttaatggcttttgaacaaagcagaaaagtttgagcttctcaccttcagtcttagctcttgaacctgttgagaaagaggataagagacaaatacggaaaagagtttcagaaagcagaatctgtgtcagcccactggaaggaaaagcgaatcaaccgattcagtgatgttagtgcatccagaaacaggcttttgggaaaagcttgacctgagctgattaaatcctgaagcacaagggaagcagccacatcaaaaagttagcatgagagcagtggcgtgctcatcctctggtagcctttactgggcatttgtggagtaagagagaaaagaaaagcaggaatgttaagatatgctactaccttcaggaaaaagtaaaattaatgttttagtaagaaactgactattgtccaccttttattg

SEQ ID NO: 289734 - DNA, 1203 bp, Homo sapiens
ctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaaggtattctgctgcctacatgcctgaaatcagggcttagggcgaccaggacaaaaggcaacaatacccagtgaactaaagcagtgctttgataacattccttttacaactcagtttgtggtaggattcctacactctgcaagactgtgaatccccagtgaaacaaaccaaaacaaagctagccactacaaggggctttgaggtctctgacactgggagcgtggatggtggtgcctggtttaggcactgacgttgtattgtgatatgatcatggaggaagctgctatgagcagggcctagtacagtgctctacatacagtatcatacagatttgactggcaaggccactctgcattgaattctcaccatgcagtgtaaagggcacataagccccttcaagctaattccaagtgaatttaactatgtatctatatatagttcacatctagcctacctctaagaaaatgctgcttatattgtgtcctgctcgctggtcctagtcctttagacctcaaagcatgagaagcaagcctttggtgtggttcagaggacaacctgagcaggcttccctgtcttttttacgcccctggtccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatg

SEQ ID NO: 289735 - DNA, 1192 bp, Homo sapiens
ctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatgaaaaaaaaataaaataaagaaaaataga

SEQ ID NO: 289736 - DNA, 1219 bp, Homo sapiens
ggcggggagggggtggctaggggcccaaggagaggaatgcggcctagacggtactgcagcccaaccgtcgccatcgccatcccgggccccaaatcctccccttaggctgtgctttctctctcaggagctccccatggctactgcgctacccctgggcaccgagatacattaagcctactaactaccacttattgagcgttttaccatgtgccagccttaccatgatttgcagatgtctgagttccatgtaaacagaagttaactctctgcgggctgtcatcttcttttgaggaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatg

SEQ ID NO: 289737 - DNA, 1058 bp, Homo sapiens
ctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagtgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatg

SEQ ID NO: 289738 - DNA, 331 bp, Homo sapiens
aatgcctagaaggtattctgctgcctacatgcctgaaatcagggcttagggcgaccaggacaaaaggcaacaatacccagtgaactaaagcagtgctttgataacattccttttacaactcagtttgtggtaggattcctacactctgcaagactgtgaatccccagtgaaacaaaccaaaacaaagctagccactacaaggggctttgaggtctctgacactgggagcgtggatggtggtgcctggtttaggcactgacgttgtattgtgatatgatcatggaggaagctgctatgagcagggcctagtacagtgctctacatacagtat

SEQ ID NO: 289739 - DNA, 419 bp, Homo sapiens
ggctcactctagagagggagacaaagagcccttaaactttatactggggcacctgctcaccccggcttttccttcttccttcagaatggttcttcgagtttggctttgtgatccctaactccacaaatacctggcagtccttgatagaggcagcacccgagtcccagatgatgccagcaagcgtcttaacgtgagtgagcaggtctcaggaaattatgaagtgtgtctagaaacaggcattccaggcaggtgggactcctggtgccattcagtgggcagagagctcggttgagaaatagagtaaaagagtatccaagggtatctaggtttccaggttcctgacctttttcatatgaaaaagacagtatgatagagtagaaagaataaaaaactaaaaataaaaataaaactttagatta

SEQ ID NO: 289740 - DNA, 4113 bp, Homo sapiens
caaagagcggctcgcgcgctggcctgggctctaaccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaagagacgagaatgtggctattcttgtagccctttgaatgtggtagacttgattgtggatattatgtttatcatagatattttaataaacttcagaacaacatatgttaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctctcaatgtgcatctttgccctgaatgcacactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcactccaaggagacaccctcgttcactgtggggatgtcctcactgcactttatttcttatccagaggctccattgaaatctcaaagaatgacatggtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcatcaaggcat

SEQ ID NO: 289741 - DNA, 3872 bp, Homo sapiens
gaatgaagaaggccaggagtaaaaatatagagagaagtgaagactggaaaactggagaacatctttatcttatttgaagtggcccataacccttcagctctacttcatggcagggacattttattttcttccatatagacctaatattttgcaaataattgcctgccaatggttcttcaagtgtgagaccatcagcatcaccttgcaatgtgtttgaagtgcaagttcttgggccctacaccagaacaactgattcggaaacacagaaattcaccaagctgtgttttaacaaacacttcaggtcattctgatgcccaagaagggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaagagacgagaatgtggctattcttgtagccctttgaatgtggtagacttgattgtggatattatgtttatcatagatattttaataaacttcagaacaacatatgttaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctctcaatgtgcatctttgccctgaatgcacactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcactccaaggagacaccctcgttcactgtggggatgtcctcactgcactttatttcttatccagaggctccattgaaatctcaaagaatgacatggtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcatcaaggcat

SEQ ID NO: 289742 - DNA, 1302 bp, Homo sapiens
gaatgaagaaggccaggagtaaaaatatagagagaagtgaagactggaaaactggagaacatctttatcttatttgaagtggcccataacccttcagctctacttcatggcagggacattttattttcttccatatagacctaatattttgcaaataattgcctgccaatggttcttcaagtgtgagaccatcagcatcaccttgcaatgtgtttgaagtgcaagttcttgggccctacaccagaacaactgattcggaaacacagaaattcaccaagctgtgttttaacaaacacttcaggtcattctgatgcccaagaagggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggatctctttatccctacatcacgagggccttagtagaacacctggcagaatggagttcatcaaatgtttgctgaataaatgagtgcataaatggatggaagagttagccaagggaagggataagaattccaggtagaaaaaaacacaagaacaaagttatgaaagcagtaaagtccatatgactttttagaacaagtggttttctgagctggcgagaggctagtctggaaaatttaccttcaaaataacacttttctaccttttcacataagtgccatgggggtttgagtaaaatgcaacagtttccatcaaaag

SEQ ID NO: 289743 - DNA, 229 bp, Homo sapiens
gggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtatgtatgtctgttttccaaaatgaaagtgccgcaggcattatagtgatagccaaaatggaataaaagccggaatcaccagctttg

SEQ ID NO: 289744 - DNA, 208 bp, Homo sapiens
acaatggtcgcaatgtcaaaggtaatgtacaaactcaaatttcaccatctgatgttcaacctgcccctttactcggcatgttaacttgcctgctgtatgccctgttcagtgcaacatcttcatgctgcccttagctatttggggtgcctggtggagacatcatggcttgattttgctacagacattgttatttctctgctgtgttacc

SEQ ID NO: 289745 - DNA, 959 bp, Homo sapiens
ctttttttagataagcatacacttcctttatttatttttcttaatttaagtattgtgtggttatggatcgtttacagcagtgtatgaaactttaagatacctagaaaaatgcaagttaaattaagacattataggtatattttaggtttgtgtagcacatagcaaatagtctagatgaacagatgagacacgtaacaacactgaatagttacagctgtgcactattttaaacgaatgaccagacactaaaatttgattattttttccatttgtagttatgcagaagttagggctgaaagacgacgagaacttggcattgaagagtctcttcctgagacagctgctgacaaagtatgtttcttataattaaaaaaaattatttttaatttctccccaataaaagatgaaactcaataattaataggaaaactatttttcaaaaatactttatttcctcacttataacagggatgtgattatactttactacttatttttaatttaatattttagagtctcacctgcctctaaaaagaaaattggatgagagatgtgtctgatctcaaaactaccatttattcccagtgatgtactagtctctggctaggttatttatatgaattatgaaatataatttacacatcagatatttttatcgggtaggtaatatccccactttgaaaatactgaaattggggtttcaagaggggaaaaaaaaatcttccctaaagacactggctgggaaattatagtcagaattggaactctggtttcttttttgttatatcaggtcagaagtatagtatattagttatctatagctgtgtaacaacttactccaaaatttagtgatataaaacaacacacttgttatctcctagtttggtgagtcaagagtccaggcacagtttagctggaccctctacttcagattctttcatgaggctgtaatcaaggtg

SEQ ID NO: 289746 - DNA, 5826 bp, Homo sapiens
ccccccccccggccccctggagcgagaggcgaaggaaatctggccgccgccgccgcgagcgctcccgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcacagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggatttttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggagttacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaa

SEQ ID NO: 289747 - DNA, 6091 bp, Homo sapiens
atttaaggagagctgggaacggatcccttaggttcaggaagcttctgtgcaagctgcgaggaaaaaaacttctgaggtaataaataggattatcccgtatcgaaggcctttttggacaggtggtgtgtggtggccttggtatgtgctttctcgtgttacatcgcgccatcattggtatatggttagtgtgttggttagtaggcctagtatgaggagcgttatggagtggaagtgaaaccacatgcctatcatatagtaaaacccagcccatgacccctaacagggccctctcagccctcctaatgacctccggcgccgccgcaagccacacgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcacagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggatttttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggagttacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaa

SEQ ID NO: 289748 - DNA, 6407 bp, Homo sapiens
cgcccaatgccgcggggcggccagctcctccggggaacccccgccctcccggcgcccggcccgcgtgcgcagtccgcagtccgaacggccgccgttgccggcgcgggctggttccgttagtggtggtggttccggggttccgttcctaggcagcgcgcggctattagcgtctgactccagcgaccgcgcgcgggttcgagggttggcggcgaggcgctcggtttctcttcttccgtccacccgcgcttcccgttccccgtcaccgccgctggcgtttgtagatttctttccgccagtgaagctgggttttctggagttggctctggcgctctggcccctggagtgtaatttcctacacgcagcgccgcagagtttatattctttgaaagtgtttgtagctttgtagaggtcctcttgttgatggtaggtgagcctaattctgcaagataaaagcctagtctctgacctggcagatgaaagatcaaatcagattgtggtttcctgctattagaatgccgtgctattagactttaaggctttttagccttctttaaaaaataaaaaaatttttacagtggaagaaaagcacaagaagtaaacttttacagtcgttgatttgactataacgctgatccccccaaatcaaagaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcacagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggatttttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggagttacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaa

SEQ ID NO: 289749 - DNA, 5456 bp, Homo sapiens
tacatgctgtgtcatgtctaaattaacattgtattaaactacttgtgtaattaaatggattgtttaaaaaatgcatatttttcatttcatcagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcacagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggatttttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggagttacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaa

SEQ ID NO: 289750 - DNA, 4381 bp, Homo sapiens
tagaggtagagagctggaagcgtaccagctggggtactggtaaagcttgcagggaagctgcccactaggatgtcattgagacttgctggaaagccacctgccggggagctgacaaggctaactgggaagcttcccgttggcaccctgacataagagcaagaaggaaaagcaccagaaccaggagttgagcactttcttggcagtgtccctccagcaccacctactgatgtggataactttgtgcctgctggcaaaggagaaatattttgaaggtccaggtccaatattacaaagcagagcaaagatgggtggattagaaactaagggacataactagtgaagggttatcatccttcactcatgttatactgcttacttttcatgttgtgcaattataaggagtaagtaattctaaaatatattacactttttccgtacatggtacttcagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcacagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggatttttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggagttacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaa

SEQ ID NO: 289751 - DNA, 4615 bp, Homo sapiens
ctttttttagataagcatacacttcctttatttatttttcttaatttaagtattgtgtggttatggatcgtttacagcagtgtatgaaactttaagatacctagaaaaatgcaagttaaattaagacattataggtatattttaggtttgtgtagcacatagcaaatagtctagatgaacagatgagacacgtaacaacactgaatagttacagctgtgcactattttaaacgaatgaccagacactaaaatttgattattttttccatttgtagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctgggttgaattttggttccgttcaactttcttctggaaattcatctaacatccagcaacttgcacctataaatatgcaaggccaagttgttcctactaaccagattcaaagtggaatgaatactggacacattggcacaactcagcacatgatacaacaacagactttacagagtacatcaactcagagtcaacaaaatgtactgagtgggcacagtcagcaaacatctctacccagtcagacacagagcactcttacagccccactgtataacactatggtgatttctcagcctgcagccggaagcatggtccagattccatctagtatgccacaaaacagcacccagagtgctgcagtaactacattcactcaggacaggcagataagattttctcaaggtcaacaacttgtgaccaaattagtgactgctcctgtagcttgtggggcagtcatggtacctagtactatgcttatgggccaggtggtgactgcatatcctacttttgctacacaacagcaacagtcacagacattgtcagtaacgcagcagcagcagcagcagagctcccaggagcagcagctcacttcagttcagcaaccatctcaggctcagctgacccagccaccgcaacaatttttacagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcacagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggatttttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttatagaggtaaaatttgcacacaaaacatcttaggcactttttaacattctcaatcatgggaattttaacttttgggatttgttgaaatcttttttattatccttcacaatttcaatgcttcttttagtcagaaatgattcagggttatttgaggggaaaaaaccccatagtgccttgattttaattcaggtgataactcaccatcttgaagtcattgtccggtttccgtagcagttttgaaaccttagtacctttttaacagcatgtgggtgtcagtgtcattattagtctcctaataagttcctctgaagactgctatcagtctcttggactggagttacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaa

SEQ ID NO: 289752 - DNA, 2435 bp, Homo sapiens
atttaaggagagctgggaacggatcccttaggttcaggaagcttctgtgcaagctgcgaggaaaaaaacttctgaggtaataaataggattatcccgtatcgaaggcctttttggacaggtggtgtgtggtggccttggtatgtgctttctcgtgttacatcgcgccatcattggtatatggttagtgtgttggttagtaggcctagtatgaggagcgttatggagtggaagtgaaaccacatgcctatcatatagtaaaacccagcccatgacccctaacagggccctctcagccctcctaatgacctccggcgccgccgcaagccacacgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaagtatgtttcttataattaaaaaaaattatttttaatttctccccaataaaagatgaaactcaataattaataggaaaactatttttcaaaaatactttatttcctcacttataacagggatgtgattatactttactacttatttttaatttaatattttagagtctcacctgcctctaaaaagaaaattggatgagagatgtgtctgatctcaaaactaccatttattcccagtgatgtactagtctctggctaggttatttatatgaattatgaaatataatttacacatcagatatttttatcgggtaggtaatatccccactttgaaaatactgaaattggggtttcaagaggggaaaaaaaaatcttccctaaagacactggctgggaaattatagtcagaattggaactctggtttcttttttgttatatcaggtcagaagtatagtatattagttatctatagctgtgtaacaacttactccaaaatttagtgatataaaacaacacacttgttatctcctagtttggtgagtcaagagtccaggcacagtttagctggaccctctacttcagattctttcatgaggctgtaatcaaggtg

SEQ ID NO: 289753 - DNA, 2381 bp, Homo sapiens
atttaaggagagctgggaacggatcccttaggttcaggaagcttctgtgcaagctgcgaggaaaaaaacttctgaggtaataaataggattatcccgtatcgaaggcctttttggacaggtggtgtgtggtggccttggtatgtgctttctcgtgttacatcgcgccatcattggtatatggttagtgtgttggttagtaggcctagtatgaggagcgttatggagtggaagtgaaaccacatgcctatcatatagtaaaacccagcccatgacccctaacagggccctctcagccctcctaatgacctccggcgccgccgcaagccacacgaatttttacttgttcctgcaaagctgctggagctcagaagctgattctatcacattgtaagatgcctttggataattctacagtcctcttaaatgaatctttagaacttggcaagtctcactagataccttcaatcatcattttgagctcaaagaattctgagacttatggttggtcatatagaagagtaccttgaacctatagtttcctgaagaatcagtttaaaagatccaaggagtacaaaaggagaagtacaaatgtctactacaagacgaaaacgtagtatgttatgttgtttaccgtaagctgtagtaaaatgagctcgattgttgacagagatgacagtagtatttttgatgggttggtggaagaagatgacaaggacaaagcgaaaagagtatctagaaacaaatctgaaaagaaacgtagagatcaatttaatgttctcattaaagaactgggatccatgcttcctggtaatgctagaaagatggacaaatctactgttctgcagaaaagcattgattttttacgaaaacataaagaaatcactgcacagtcagatgctagtgaaattcgacaggactggaaacctacattccttagtaatgaagagtttacacaattaatgttagaggctcttgatggtttttttttagcaatcatgacagatggaagcataatatatgtgtctgagagtgtaacttcattacttgaacatttaccatctgatcttgtggatcaaagtatatttaattttatcccagaaggggaacattcagaggtttataaaatactctctactcatctgctggaaagtgattcattaaccccagaatatttaaaatcaaaaaatcagttagaattctgttgtcacatgctgcgaggaacaatagacccaaaggagccatctacctatgaatatgtaaaatttataggaaatttcaaatctttaaacagtgtatcctcttcagcacacaatggttttgaaggaactatacaacgcacacataggccatcttatgaagatagagtttgttttgtagctactgtcaggttagctacacctcagttcatcaaggaaatgtgcactgttgaagaacccaatgaagagtttacatctagacatagtttagaatggaagtttctgtttctagatcacagggcaccacccataatagggtatttgccatttgaagttctgggaacatcaggctatgattactatcatgtggatgacctagaaaatttggcaaaatgtcatgagcacttaatgcaatatgggaaaggcaaatcatgttattataggttcctgactaaggggcaacagtggatttggcttcagactcattattatatcacttaccatcagtggaattcaaggccagagtttattgtttgtactcacactgtagtaagttatgcagaagttagggctgaaagacgacgagaacttggcattgaagagtctcttcctgagacagctgctgacaaaagccaagattctgggtcagataatcgtataaacacagtcagtctcaaggaagcattggaaaggtttgatcacagcccaaccccttctgcctcttctcggagttcaagaaaatcatctcacacggccgtctcagacccttcctcaacaccaaccaagatcccgacggatacgagcactccacccaggcagcatttaccagctcatgagaagatggtgcaaagaaggtcatcatttagtagtcagtccataaattcccagtctgttggttcatcattaacacagccagtgatgtctcaagctacaaatttaccaattccacaaggcatgtcccaggcattgcagatgccgacagtacaaatatatgaactaaaaaaccattacatctagagggaatgacagatgcctacaataccatgctatattgcctgtgctgaaagtatgtaagttgatatgtaagcagattgtgtgaatccttaatgcaacctgaggaagtgaaggaaaactttctaggagaattgtttcttggcctaagtccagaaggaggcctgaatgtg

SEQ ID NO: 289754 - DNA, 1030 bp, Homo sapiens
cctggctacaattttctgcagaaagacaaagtatatgccttaaggataacagcaaagcagaggacagagaagtcttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacacttaaaagatggtgaactgtgagtactacttaggttgacagcaacaaagcataagacaagccccaggtaaacgtctaaactgtttactcacattgtcctactccagccccttcaattatttcccatctccacaaatagtcgggggaaaaaattaaaattttcctttatgattcttactgttcttcgcagctcatcttttcctgcttagaattaaccattgctaatttaaaggagcagctagctgcttttctgtcagtctgaagcgtagtagtggaagaggtagtaagcaccagctgcctctttgctgctttgttttcctcctgattctcttaaatttgggttgcaaagctatcccgccccccaccctgccccatgaaacttgagcattcaaatgaagattcagcagtgtctgttcttcatttctatagccaaagctgttagttaaaatcccaaatctatagcatttaaagataccaaatagaaacaccttccagctttaaaaaa

SEQ ID NO: 289755 - DNA, 661 bp, Homo sapiens
tagaggtagagagctggaagcgtaccagctggggtactggtaaagcttgcagggaagctgcccactaggatgtcattgagacttgctggaaagccacctgccggggagctgacaaggctaactgggaagcttcccgttggcaccctgacataagagcaagaaggaaaagcaccagaaccaggagttgagcactttcttggcagtgtccctccagcaccacctactgatgtggataactttgtgcctgctggcaaaggagaaatattttgaaggtccaggtccaatattacaaagcagagcaaagatgggtggattagaaactaagggacataactagtgaagggttatcatccttcactcatgttatactgcttacttttcatgttgtgcaattataaggagtaagtaattctaaaatatattacactttttccgtacatggtacttcagtttcagttttcagctcaattaggagccatgcaacatctgaaagaccaattggaacaacggacacgcatgatagaagcaaatattcatcggcaacaagaagaactaagaaaaattcaagaacaacttcagatggtccatggtcaggggctgcagatgtttttgcaacaatcaaatcctggtcgacgcggccgcgaatttagtagtagtaggc

SEQ ID NO: 289756 - DNA, 325 bp, Homo sapiens
aaagctttttaactctatcttcaatagtttgtatttgggatactaaattacatttcagggcacacaactttgatttcagaaattaacaataaccagaccatatcatatgttaaacgtggttgagaaaatattaaaagcttcccgttggcaccctgacataagagcaagaaggaaaagcaccagaaccaggagttgagcactttcttggcagtgtccctccagcaccacctactgatgtggataactttgtgcctgctggcaaaggagaaatattttgaaggtccaggtccaatattacaaagcagagcaaagatgggtggattag

SEQ ID NO: 289757 - DNA, 357 bp, Homo sapiens
ggcataactgagttgatttacatgtcactttagtattgctgttgcttagtgagtctgctcttactttctctatccgctttcttttagagatgacagtagtatttttgatgggttggtggaagaagatgacaaggacaaagcgaaaaggtagtttgattagagatataaaatagtaaatgaatgaataatagataaatataatggtaaataaatagtgaataaatgatttccaaaagctatgtgctttaggagtttagatatattagcaaggtggaagaacttagaatattggtatgtagtttataaattaaatatcttctgaccttttggaaaagtattatgctttgcttaaacaga

SEQ ID NO: 289758 - DNA, 2047 bp, Homo sapiens
agcctggtgttgaattggccgaggcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggaccgtggacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289759 - DNA, 2057 bp, Homo sapiens
gtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggaccgtggacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289760 - DNA, 2045 bp, Homo sapiens
tccttgtggtcagcccccgcgatttatggctatcagtcgcacgggcctctgctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggaccgtggacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289761 - DNA, 2059 bp, Homo sapiens
gtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289762 - DNA, 2009 bp, Homo sapiens
tgcaggctgtacgcgccggaattatgggatgaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289763 - DNA, 2266 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcggacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289764 - DNA, 2011 bp, Homo sapiens
gtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289765 - DNA, 2010 bp, Homo sapiens
agcctggtgttgaattggccgaggcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289766 - DNA, 3244 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289767 - DNA, 3199 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggaccgtggcacattccggtgtgctgagccgtgaccgccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289768 - DNA, 2269 bp, Homo sapiens
gtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtcacctgcagcttccactctttatttccaaagaatcagtgtcacacatgcagatcacaaagcgggtctccctgtgctgcttccttctgtgttttctagtctctcccccaggggctgcccagggccctcaggaactgagtgtgggcaagacactgctgggccagagggcacgacgcccacgtgggcccgtattgcccaggccatttggcagtgc

SEQ ID NO: 289769 - DNA, 2965 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289770 - DNA, 2590 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289771 - DNA, 2077 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggagatagcctgggctggaagctcttctacgtcacaggctgcctgtttgtggctgtgcagaacttggaggactgggaggaaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtcacctgcagcttccactctttatttccaaagaatcagtgtcacacatgcagatcacaaagcgggtctccctgtgctgcttccttctgtgttttctagtctctcccccaggggctgcccagggccctcaggaactgagtgtgggcaagacactgctgggccagagggcacgacgcccacgtgggcccgtattgcccaggccatttggcagtgc

SEQ ID NO: 289772 - DNA, 1961 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggataaggccggctcgggtgcgggacagagtccagggctgttcagctcctgggttttttgcaatgggaatgaaaggaggaggaagggccctgggtggcctagcgcctccccgtcctgaagcgttggtccctgcttggaggtctccgttcatcaggacatggcccctgcactcatctgggaccgttcttggccaaggaattccccgaaggcatttttctcttagaagctctccatgactatcttcaccaaagtgctttcttcccagagttgccacaatgggatgcgagtcagctttccccgtggccggccctcccacctcggagcccctcatgagtcctttcagcctggcccagtgctgccctctg

SEQ ID NO: 289773 - DNA, 428 bp, Homo sapiens
gcgcgtgtgggtcctgagtggccagggcagggtcagcagcacaggaagctgcccagggggtccttgcaagcgtgggctctggcagcgtctgggggaggctgtctaggcggggcctcccgtgggcatgtcctggagctcacaggctggcgccctatgcccatctccagatagcctgggctggaagctcttctacgtcacaggctgcctgtttgtggctgtgcagaacttggaggactgggaggataaggccggctcgggtgcgggacagagtccagggctgttcagctcctgggttttttgcaatgggaatgaaaggaggaggaagggccctgggtggcctagcgcctccccgtcctgaagcgttggtccctgcttggaggtctccgttcatcaggacatggcccctgcactcatctgggaccgttctt

SEQ ID NO: 289774 - DNA, 2046 bp, Homo sapiens
aatgttagctagtagaaggctggtttaaattggccgagggccggttcgcgttctctgctgcggcgcggggaccgctgtgctctcgacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggaccgtggacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289775 - DNA, 3321 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289776 - DNA, 2319 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289777 - DNA, 2049 bp, Homo sapiens
acgcgtgggtgcggcgcggggaccgctgtgctctcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289778 - DNA, 3205 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289779 - DNA, 1884 bp, Homo sapiens
agcctggtgttgaattggccgaggcgcggccccgcccccgccggttcgcgtctctctgctgcggcgcggggaccgctgtgctctcgatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289780 - DNA, 3238 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggaccgtggcacattccggtgtgctgagccgtgaccgccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289781 - DNA, 2715 bp, Homo sapiens
agcctggtgttgaattggccgaggcgcggccccgcccccgccggttcgcgtctctctgctgcggcgcggggaccgctgtgctctcggtaggcggctgggctgggtgggctccgcacttccttcccgctccgtgccgcgcgtcccggcacccttaggcccactccgggaggggtctgcgtcctgggcccgcctgccggctgttccgtgtcccgccgtgcccgtcgcgggcggcctcgcgcctgttccgctgcaggttggccccggcggcgggagcgcccccgatccggacaaagaaacgagcgctcggtgcgactagcggcgcgggcgctttgccagcgcgcgtgtgcttgtgtccgcgagtgtgcgtgtgtgtgtgcatttggatgtggaatgccgggtgtttcgggagcaatgaggcaactgaggcccgggagggagcccagtcatataccagcatctaggattggtttgtgtgatttgaacccactattttttatttttttgagacacggtctcactctgtcacccaggctggagtccagtggcacgatttctgctcactgcagcctccacctcccggcctcaggtgatcctcccagctcagcctcctgaataactaggaccacaggcgtacaccaccacaccgggctgttttatgtattttctgtggagacggggtttcgccacgttgccctggctggtcttgaactccgtgactcaaacaatccgcacgcctcgtcctcccaaagtgctgagattacaggcctgagccaccgcgcccagcctgaaccccctacttaatgtcagaaatttgatttgacttcacagggaaagccctgagaaactaccagaacggggtccctggggccagtgttgggagcgtacggtgatagtggcagggctgctgcgccggtgcggaactcccgtgtggaagattagcccctttggtgactcgtcggttctggccgctttgggaccctctactgtgcagtctgaactttcagcaggtggaggagggcagagagagagctgagatcgttggtccatgccagtgcgagagccagtacggccggaagccatgatgggactttcagttcctttcttggtggaggccagcacaggggagagggggtgcccacagatgctagaagcttaaaggctgctgggggctagcggcctcaggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccagacccctcctcctgtagagagtggtgctgccctctcgggatgtacctgcaggtggagacccgcaccagctcccgcctccatctgaagagggctccaggcatccggtcctggtccctgctggttggaatcttgtcgattggcctggctgctgcctactacagcggagatagcctgggctggaagctcttctacgtcacaggctgcctgtttgtggctgtgcagaacttggaggactgggaggaagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggaaaaactgggagattttctgcagaaattgagttccagcctctctcgaacctgggaagacctggcaggagggggctgggctctcggctacagacttctccccaccccgtaggagctgaacgccaaccatcctgacccgccagtgctcttggtctcctgagtgtacccaggtcctcccaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtca

SEQ ID NO: 289782 - DNA, 1838 bp, Homo sapiens
agcctggtgttgaattggccgaggcgcggccccgcccccgccggttcgcgtctctctgctgcggcgcggggaccgctgtgctctcagccatcttcgacaagagcacagggaaggttgttttgaagacgttcagcctctacaagaagctgctgactcttttcagagctggccacgaccaggtggtggtcctgctccatgatgtccgtgatgtgagcgtggaggaggagaaggtccggtacttcgggaaaggctacatggtggtgctccggcttgcgacgggcttctcccaccccctcacgcagagtgcagtcatgggccaccgcagtgatgtggaagccatcgccaagctcatcaccagcttcctggagctgcactgccttgagagccccacagagctgtctcagagcagcgacagtgaggccggtgaccctgcaagccagagctgacagccccactgtgcctgagcccgtgcaccgcccacaggacccatggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggcacattcccggtgtgcctgagcccgtgcaccgcccacaggacccgtggccttggcttcagttggtgcctccagccgagttggcctattgcctgctcatgctgctgcttgcacactgcatgaaacagcaggccagaccaggacatccagactttctccatcgtgaggcctgggcctgcctttctgcagccggaggtctcgccagccctggactcctgctttgggccacagcaagacctcgggcgagtggagaggcggggccaggccgggcccttgtgggtgctgatgctgcatgttgtccccgacacagcgtcctctccctggtggacatccccagcggtcaggtgcttccccaagggcagtgaggggtgaacatccagggcctacctggctgtgcacgctgcagccacactgtggaagctgcccctccccgaggacccgcctcccttgctgatgccaggatctcggcgcatagaccactctgccccagcggtcgtcacagaaaggtctctctgttcctcacactcagcttcagcataagctgtgaggccagaaaaaaggtcagctcttctagtatcgtgcagtgcttaaaaaccgggagctccagccgggcgcagtggttcatgccagtaatcccagcactttcggaggccgaggtgggaggattgcttgaggccaggagttcaagaccagcctgggcaacacagcaagatcctgtctttgtaaaaaaactaaccaaacaggtgcggtgtgcaccgagcgcgcctggcctgatgccctggcctgtgagctggggactcctgggccctgtgagcccctaggcggcaggcccaggaatggctgggtaggacagggaacacctttgccccacgtctggctgtgacctcggtgaaagccgacaggagagagatgggaccctcctcctcagtagtggctgccagtccctcgttgcaggacagggtcatcataaccataaataacccttcacgtgtcacctgcagcttccactctttatttccaaagaatcagtgtcacacatgcagatcacaaagcgggtctccctgtgctgcttccttctgtgttttctagtctctcccccaggggctgcccagggccctcaggaactgagtgtgggcaagacactgctgggccagagggcacgacgcccacgtgggcccgtattgcccaggccatttggcagtgc

SEQ ID NO: 289783 - DNA, 529 bp, Homo sapiens
caggacataaggtttccagacaggacggggcaggtggtgatgcagctgtagctcgtgagtctgagcgggaaacagcccccgcgcagtcggtgtcgctgtgaacggaaaagggccttccttacacactcggaaacggggtctctgggggatccagtgacgtgcccaaccacagagaccaccaggtgagactggctgatggtgtctggggctgcaggtgacttagttgggggacctgctcttggcctccagactgggcctgatgcgtgggcgctgcctgtgtgcagcgcaagggctcagctgcctctgtctgttcccagacccctcctcctgtagagagtggtgctgccctctcgggatgtacctgcaggtggagacccgcaccagctcccgcctccatctgaagagggctccaggcatccggtcctggtccctgctggttggaggtaaggctctccacgtccctccccagaaccccagaaccggaagcctgactttcaaaaaggatgaaaatgaaacaaaatattttctc

SEQ ID NO: 289784 - DNA, 483 bp, Homo sapiens
ccagactcagcctcctcagacaaaaaatcccactctgttcccaggccggagagcctcctgggctggaattgctcaagcctcagctcacagatgagtcactgtattcatttgctccacagaagaaagaatcttcaggcctctgctcttgtgagagtaatttctcttaacaccgacagtgcagcctactccatgtgctactttctctcgcaactttgagcaagaatgttagatcttttgctgggggccttcggaagccgtgagggagcatatcctgacacccacatagaagacctggtacctatgtttccacatcacaaagcaggccaacaagcacacaaggccgcagaccaaattaagaatcatctggatgagtaagaacagtttgaaagtgccagtgacgctggtacagtccgtcacatcccggtaaacaaaggtcctgctgagcggctccgaggagggcagtttgcactggcaagagtcgag

SEQ ID NO: 289785 - DNA, 523 bp, Homo sapiens
cggggaagcaccgcccacagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatata

SEQ ID NO: 289786 - DNA, 1334 bp, Homo sapiens
cggggaagcaccgcccacagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaatatagcataggaataaagatttcactagaaattgcaatttattatgttttggaggttgtaaggaagtcttgttttttggtttattttactgttttgtgatcttgtatgcaaatcctgataaccattaaccttctcaaacttaatgtctgagagcctcataaaatcaacatatttacttattaagcagtttatgaaactttaatggggcccctcctgtgccaagggtacgtatattgtgaagtaaagcctcacaaagctaaataaattctcttccatacctttaatga

SEQ ID NO: 289787 - DNA, 600 bp, Homo sapiens
  misc_feature (536)..(536): n is a, c, g, or t
  misc_feature (538)..(538): n is a, c, g, or t
cggggaagcaccgcccacagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatataaaaaaaaaaaaananaaaagaaaaaaaaaaagaaaaacaaaaaaagaaaaaaaaaaaaaaaaaagggggggggggcc

SEQ ID NO: 289788 - DNA, 565 bp, Homo sapiens
cggggaagcaccgcccacagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatataaacaaaaaaagaaaaaaaaaaaaaaaaaagggggggggggcc

SEQ ID NO: 289789 - DNA, 673 bp, Homo sapiens
cgggcccattaggtataggtgaacatggtcagtagtctgtttccttaggatcatccatggtcaatgacctagtgctttggatttcctcacctaattgaaaaagacgcccaggcggcgaatccgatgctgttcgtgaagcaatatccaggatggagttcgtgagggtcattgactaggatctagtcaagcaggatgtccaagcgagctcgagtatcaagacttacgccccgtgtgtgaggatgggactttgagcctgttggaccgggcagtgaggtgggtccggcgccgagggttcgagccttgcggcaaccgtgcagcatcttggcaggtaggtcctgtacctactgccgggatcccccgctcctccgccaggaccttgttagtcttaggcgtgtgcgggtgaggcgaccctggcggtagcctggccaatcgccgtctaggattggctgtggtgcccccgatcagccaatcggaaggaaggcggtagcggggcgtggaaggaagcgaaccctggatctgacccactgtcccttcaaggtctcgggaatggtcgggcaactggccccgcgtactgcgtcctcgccggagcgggttctccccaacctctccaagcgtctggctacaggccagatgagggaaatagaaaagtaaacttaagtttaattagtatgtg

SEQ ID NO: 289790 - DNA, 899 bp, Homo sapiens
cggggaagcaccgcccacagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttagagatacggtccgagctcgatacc

SEQ ID NO: 289791 - DNA, 1902 bp, Homo sapiens
aagatggagtctcactctgtagcccaggctggagtgcagtggcacgatctcagctcactgcaacctctgcctccggagtcccggttggttcaagcagttctcctgcctcagcctcccaagtagctaggattacaggcacgcatcaccatgcccagctaatttttgtatttttagtagagatggggtttcaccatgttggccaggctggtcttgaactcctgacctcgtgatccgtccgcctcggcctcccaaagtgttgggattataggcgtgagccatcacgctgggccttgtttttctttttgtttttgttttaatttttggtagagacggggtttcaccatgttgcccaggctggtctcaaactcctgcactcacgcaatctgcctgtctgggcctcccccaatctataagtcatgcaacataaactctacatcatctcctccattgggttgctttgaagtgaagtacaccttcgatagtacaatgaagtcttgtgatatataaagtacaaagttgtgtttaccgggtagaccaagttaataattcatagaccagctttcctggttggggaagagtataatttaaagttgctgtaaaatagtaattttaacaaacgtatctacttatgaggtttagtagatcatttcttttagttaatgagattgtttttcatgcatattacttttcatttaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaatatagcataggaataaagatttcactagaaattgcaatttattatgttttggaggttgtaaggaagtcttgttttttggtttattttactgttttgtgatcttgtatgcaaatcctgataaccattaaccttctcaaacttaatgtctgagagcctcataaaatcaacatatttacttattaagcagtttatgaaactttaatggggcccctcctgtgccaagggtacgtatattgtgaagtaaagcctcacaaagctaaataaattctcttccatacctttaatga

SEQ ID NO: 289792 - DNA, 1574 bp, Homo sapiens
cggggaagcaccgcccacagctgcccgggactccagtgatcgccgcggctcgctcgcgccccggaaactgccccttctcgggggtcatgatgggcagcaagatggcgtctgctagtagggtcgttcaggtaaagcaatttgtcgcgtttccgcatcttgggcggtagggacggtgctgactatggcgacggcgtcggggagtaaaggcggtggcagaggcagagcggtgaccgcgcctctgcggagggccagtgacggcgcccgcgggtgtgtgtgaggatgggactttgagcctgttggaccgggcagtgaggtgggtccggcgccgagggttcgagccttgcggcaaccgtgcagcatcttggcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaatgttagcctattaatttactcttgattatcaaacattaccagtgttgaactattaaaagcacacaatgtgtagtaaactatcataggattcccataatttcactttactttctgtttaggcatggaaaaatttatcagtcagaattgctgttttagggacatgattttcctgaaattgggtgaggatcagtgaaataattactctattacttgttcttaattctctgttctctaatgttttttcattcacaagtttactggagtataactggcttagtaagtatatcctactctgaatgataaaaatatagtcaagctaaaataggtgactatactattaagatagagatcatacaaaagattccaaagaaagtcaaaaagtgtaaaatggaaaataagagatcaaaatgaatatagcataggaataaagatttcactagaaattgcaatttattatgttttggaggttgtaaggaagtcttgttttttggtttattttactgttttgtgatcttgtatgcaaatcctgataaccattaaccttctcaaacttaatgtctgagagcctcataaaatcaacatatttacttattaagcagtttatgaaactttaatggggcccctcctgtgccaagggtacgtatattgtgaagtaaagcctcacaaagctaaataaattctcttccatacctttaatga

SEQ ID NO: 289793 - DNA, 763 bp, Homo sapiens
cggggaagcaccgcccacagctgcccgggactccagtgatcgccgcggctcgctcgcgccccggaaactgccccttctcgggggtcatgatgggcagcaagatggcgtctgctagtagggtcgttcaggtaaagcaatttgtcgcgtttccgcatcttgggcggtagggacggtgctgactatggcgacggcgtcggggagtaaaggcggtggcagaggcagagcggtgaccgcgcctctgcggagggccagtgacggcgcccgcgggtgtgtgtgaggatgggactttgagcctgttggaccgggcagtgaggtgggtccggcgccgagggttcgagccttgcggcaaccgtgcagcatcttggcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatata

SEQ ID NO: 289794 - DNA, 589 bp, Homo sapiens
  misc_feature (1)..(1): n is a, c, g, or t
  misc_feature (10)..(10): n is a, c, g, or t
  misc_feature (42)..(42): n is a, c, g, or t
  misc_feature (525)..(525): n is a, c, g, or t
  misc_feature (527)..(527): n is a, c, g, or t
ngttcgggtnagacaacccactcttggccttaataggtttcnctgaaaaaaagacatcctaaacccatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaaaaaaaaaaaaaananaaaagaaaaaaaaaaagaaaaacaaaaaaagaaaaaaaaaaaaaaaaaagggggggggggcc

SEQ ID NO: 289795 - DNA, 785 bp, Homo sapiens
cggggaagcaccgcccacagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacggtgtgtgtgcagggggggtcctgaataaccatggtggctggcctgtgggttttgggggggttttccacaaatttttctcccaaaaaggggggggaaaaacacccaagaacaacgagaccgtgttctcttttcacgacgacgggggggggcacaacaccacccaccaatcacaaccctccttttttttctcgccgcgggggggggcggggggcaggagccacacttcttcctccccgccaccacgacgaattgttttatataagccaatcaactacctgacgccatgccgccaacgtaaacaacacaacaacgccccccccctcacatacacctaacgacaacgcaccaaaccagcacccgccgccgttgcgccttcatactacacaacgacaaccagcccccg

SEQ ID NO: 289796 - DNA, 712 bp, Homo sapiens
  misc_feature (648)..(648): n is a, c, g, or t
  misc_feature (650)..(650): n is a, c, g, or t
cggggaagcaccgcccacagctgcccgggactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggtggctgctgtttgtcatcagacaatagaattgtctttacaataaaggacttccaaaatgacagatgagaaactgtatattaaacacctttaataaatattatgaaaaaaatgaaatatagaaaatttagatggacacttgtatttcctaatttatgtatcttggtcagcttctccacaagcttacctaattgtttatatactttatacttattaaagtatacatttttaaaaaaaaaaaaaaananaaaagaaaaaaaaaaagaaaaacaaaaaaagaaaaaaaaaaaaaaaaaagggggggggggcc

SEQ ID NO: 289797 - DNA, 789 bp, Homo sapiens
  misc_feature (34)..(34): n is a, c, g, or t
taggcgttgtgtgcttggtactataactcgtagngctgtgtacgtccgcattccggaaaactgcaagccgctctgttcctgggcctcggaagtgatgcctatggcgtcccctcaaaccctggtcctctatctgctggtcctggcagtcactgaagcctggggccaggaggcagtcatcccaggctgccacttgcaccccttcaatgtgacagtgcgaagtgaccgccaaggcacctgccagggctcccacgtggcacaggcctgtgtgggccactgtgagtccagcgccttcccttctcggtactctgtgctggtggccagtggttaccgacacaacatcacctccgtctctcagtgctgcaccatcagtggcctgaagaaggtcaaagtacagctgcagtgtgtggggagccggagggaggagctcgagatcttcacggccagggcctgccagtgtgacatgtgtcgcctctctcggtactagcccatcctctcccctccttcctcccctgggtcacagggcttgacattctggtgggggaaacctgtgttcaagattcaaaaactggaaggagctccagccctgatggttacttgctatggaatttttttaaataaggggagggttgttccagctttgatcctttgtaagattttgtgactgtcacctgagaagaggggagtttctgcttcttccctgcctctgcctggcccttctaaaccaatctttcatcattttacttccctctttgcccttacccctaaataaagcaagcagttcttgaattt

SEQ ID NO: 289798 - DNA, 2077 bp, Homo sapiens
aggtaagaggaaactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctaat

SEQ ID NO: 289799 - DNA, 2185 bp, Homo sapiens
aggtaagaggaaactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccaggagcagccaccatatcctagctacaattctaactattggaattctactgcgagatctagggctccttacccaagtacatatcctgtaagaccagaattgcaaggccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctaat

SEQ ID NO: 289800 - DNA, 3528 bp, Homo sapiens
cagttctgagaaactgtcccgcgtggacagggggtagatcccatcagttctcaaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggtggagatgggaggggtgggtgccaggctgcagcctgtgtcctcctgataggcccagccccctcggtggcctccgtgttcctgggggaaggaaggaaggagctggaggatacagtggtgcctatctcgggagcccagggaggcagggacacaggagtggcaggcttggggcgcccgcgtggaacagtgccaggtctacgtttacccactaccagatagactttttcatttcaagcataacttgagtctgcactggggagacactcgtggtgggggtggctgtgatgagggcacttgcgagtcccgacaacagacactggctcctgcacccacatcaccaccatgtcccaggggcagcctggaggggagtttgtggtcagagccccagccaggaaaggagagagttccagaatgttccaagagtctagccgcaggccccagacaccatgagctggagggtcgggatggggcagcctccctggtgcaatcggcacctgggcccccgggccctgtcagtgctgtcgtgaggtctgtctgccctgggtcagagcagcaggcagagccggcgcttcttctgccgttgcgccttcttcagagcgctgagagccaccttggcggcctcccggaagacgtcctccacattctcccgaaacttggcggaacattccaggtagagagcagctcggatctgttcgcaggcgctcaggccctgggtggggggaggagccagcattaggtgaggggcccctggaggtctcctagcaccacctggtgggtttgggactggctctgaggactctgcagggatggaggccttggtttgggcctgtctgtctcctccatcctggctgcccctcacagtgtgtgggtggaatggagggccagggcagtgcagcccgcaggttggaagaagccctgtccaggcccccaccctggcctctctccagctccgggcagggaggggctgaatcctgagacccggggttggttcccccaggtgtgtctcccaggcctgtgagaagagttggaggcctcaagacagaaaggacttccagccacctctctcccttctctgaaagtaccatttaggcaaattaatttgcccttttatttatttatttttgggatggagttttgctcttgttacccgggctggagtgcagtggcgcgatcttggttcatcgcgacctctgccacccgggttcgggcgattctcctgcctcggcctcccgagtggctgggattgcaggcatgcgccaccatgcccggctagtgttgtgtttttggtggagatggggtttctctcatgttggtcaggctggtctcggactcccggcctcaggtgattcgcccgcctcggcctcccaaagtgctgggattacaggcgtgggccactatgcccggccggatttgcccttattaatggttatttcttgtgaaagtttctttttgcctttgcattccttttattctgtttattcccccatgcctcacccaaagagttgcacggtcaattggcccgtgaaggggacgcctactttcaaacaaggcagacaggacacgacaggacggcggctcatagcacagactttggattgcagtggatgggaccagatcctggctccacttctcgctagctgtgtggccctgggcaagctgcttaacctctctgggcctcagtttctccccctgtaaactgggggatgtgaacagcgcctgcctccgagtcctaaggattgggagtagtcgtgtaaagtgctcaggtccacaggccatcaatactaatagttaaaaattattcttagaatcttgcttccctcagctccctgaaaggccactaaggcaccccagttgcagaggccaaaggtccgggaggcttcacagccacggctgtgccccagggtcttggccccggcccacctgcatgtaggtgatgggctccagctgggcggcccggagcttccgcagctgctccttgtccttcctcaggtctgtcttgcagccgatgagcaccatggggatcccgcggcagaaatgcgtgacctcagggaaccactgtggagggaggaggcgggatcaggggtgcggccgggcccagatgtggggccaccacccaggaggccggcctcaccttgatgaggacgttgtcgtagctggtgggattcatgacgtcatagcagatgagcacgaggtgggtgttctggtaggacaggggccgcagccggtcatagtcttcttgccctgaaagcacagagcagcgggggtcaggggacgtcccctccctgtctggactctgacgggtgaaggggaaggggccaggcaagtgaccctgccttagggcctcaatttcctcatctatacaatgggcagcaagccaggagtgctggcacaggcctgtggtcgcagctactcgggaggctgaggccggaggatcgcttgagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtgatccccctgccctgatggtcaagggcagagtgcagactggaaccctcccctccccaaagattcagacctgtggggctgagtgggctcatagtgtccccaagtcctgagaggctggtgtctggcttcagcctccagcttctcaggttctgatgcagtcagctgagttccctgcctattcttgcaagcactaggaggagggtggtgggttgctgggaacagcaccgagcgccctccccacccagattcacagagcacactccccggggggatactttaatccggaggccgtgacgcctggctccgccccgagacgagctgaatccaaatacggatctaggcttgagcttggttgggtttgcttttttcttcttcttctttataaacaattctttgtaactttttgtattgacagtttcaaacttacagtaaaattgcaacacgaagtaaaaaaagctctctgact

SEQ ID NO: 289801 - DNA, 2391 bp, Homo sapiens
cagttctgagaaactgtcccgcgtggacagggggtagatcccatcagttctcaaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggtggagatgggaggggtgggtgccaggctgcagcctgtgtcctcctgataggcccagccccctcggtggcctccgtgttcctgggggaaggaaggaaggagctggaggatacagtggtgcctatctcgggagcccagggaggcagggacacaggagtggcaggcttggggcgcccgcgtggaacagtgccaggtctacgtttacccactaccagatagactttttcatttcaagcataacttgagtctgcactggggagacactcgtggtgggggtggctgtgatgagggcacttgcgagtcccgacaacagacactggctcctgcacccacatcaccaccatgtcccaggggcagcctggaggggagtttgtggtcagagccccagccaggaaaggagagagttccagaatgttccaagagtctagccgcaggccccagacaccatgagctggagggtcgggatggggcagcctccctggtgcaatcggcacctgggcccccgggccctgtcagtgctgtcgtgaggtctgtctgccctgggtcagagcagcaggcagagccggcgcttcttctgccgttgcgccttcttcagagcgctgagagccaccttggcggcctcccggaagacgtcctccacattctcccgaaacttggcggaacattccaggtagagagcagctcggatctgttcgcaggcgctcaggccctgggtggggggaggagccagcattaggtgaggggcccctggaggtctcctagcaccacctggtgggtttgggactggctctgaggactctgcagggatggaggccttggtttgggcctgtctgtctcctccatcctggctgcccctcacagtgtgtgggtggaatggagggccagggcagtgcagcccgcaggttggaagaagccctgtccaggcccccaccctggcctctctccagctccgggcagggaggggctgaatcctgagacccggggttggttcccccaggtgtgtctcccaggcctgtgagaagagttggaggcctcaagacagaaaggacttccagccacctctctcccttctctgaaagtaccatttaggcaaattaatttgcccttttatttatttatttttgggatggagttttgctcttgttacccgggctggagtgcagtggcgcgatcttggttcatcgcgacctctgccacccgggttcgggcgattctcctgcctcggcctcccgagtggctgggattgcaggcatgcgccaccatgcccggctagtgttgtgtttttggtggagatggggtttctctcatgttggtcaggctggtctcggactcccggcctcaggtgattcgcccgcctcggcctcccaaagtgctgggattacaggcgtgggccactatgcccggccggatttgcccttattaatggttatttcttgtgaaagtttctttttgcctttgcattccttttattctgtttattcccccatgcctcacccaaagagttgcacggtcaattggcccgtgaaggggacgcctactttcaaacaaggcagacaggacacgacaggacggcggctcatagcacagactttggattgcagtggatgggaccagatcctggctccacttctcgctagctgtgtggccctgggcaagctgcttaacctctctgggcctcagtttctccccctgtaaactgggggatgtgaacagcgcctgcctccgagtcctaaggattgggagtagtcgtgtaaagtgctcaggtccacaggccatcaatactaatagttaaaaattattcttagaatcttgcttccctcacctgaccaacatggagaaaccctgtctctactaaaaatacaaaattatccgggcgtggtggcacatgcctgtaatcccagctactcggaggctgaggcaggagaatcgcttgaaccctggaggcggaggttgcggtgagcccagatcacaccattgcctgggcaacaagagcg

SEQ ID NO: 289802 - DNA, 916 bp, Homo sapiens
ccccctaactgtggccctacaaatccctaggccagacctcacagcagtgcccacaggcatgccttgtttagccctcctcaaggaattttaaaatttttaattactttttttttttttgagacagggtctgttgcctaggcgggagtgcagtggcatcataggtcactgtagcctccgcctccagggctcaagggatcctcccacctcagcctctggagtagctgggaccacaatcacacaccaccatgccctgctccttttttttttttttttttgagatgggaacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtgatccccctgccctgatggtcaagggcagagtgcagactggaaccctcccctccccaaagattcagacctgtggggctgagtgggctcatagtgtccccaagtcctgagaggctggtgtctggcttcagcctccagcttctcaggttctgatgcagtcagctgagttccctgcctattcttgcaagcactaggaggagggtggtgggttgctgggaacagcaccgagcgccctccccacccagattcacagagcacactccccggggggatactttaatccggaggccgtgacgcctggctccgccccgagacgagctgaatccaaatacggatctaggcttgagcttggttgggtttgcttttttcttcttcttctttataaacaattctttgtaactttttgtattgacagtttcaaacttacagtaaaattgcaacacgaagtaaaaaaagctctctgact

SEQ ID NO: 289803 - DNA, 1252 bp, Homo sapiens
tgatggcgagaaacgctgcaggacccggctctggctcctcctcaaccttccctcgctgacgctaagatagcagcgtctccgaagagacagcagcacgagcccatttactgaattcaaccctaccccgcagaaccgcctcccgttatcgtttagacagtggctgactcaccctctctcactcccgcgtcctttctccgcgtctgctcgccttcacaggacccgctggcttggagccgcagaagccgctactgcagcgtgggcgacaatgctaggcgcccaggagaactaccgctcccaggttgcctttcgcgccccgagggctgctgggactctcggactcccgggccgagaccgagggaaagaatccgctttgcatgtcgggagtagtagtttgtgtaatatcgcgatccttctctggtgttccttgttttagctgacgacactcgagagcgccaattttcctagattcgattttgtggtttggaactgtggttttggaatccagagtagtcgcctcgttctagtatccaattgctccagcaccaactggtgaaaagaccatcattcttctactcagttgcatttgaagctttgtcaaaaaccagacacaattggagacacaggttcttctatcaaggccttgactggaatggcatattttcagatatgaccacattgctttgaggaaatgaggctgatgttgcagagctgataaaacccccacagaaaggccagcctacctctggtgttggccagattgagaaataaagggaaagagtacgaaagagagaaattttaaagctgggtgtccgggggagacatcatatgtcagcaggttccgtgatgcccctcaagccacaaaaccagcaagtttttattagtgattttcaaaggggagggagtgtatgggtcacagagatcacatgcttcacaaggcaataaaatatcacaaggcaaatgggggcagagcgagatcacaggaccagggcaaaattaaaattgctaatgaagttttgagcacgcattgtcattgataacatcttaccaggagacagggtttgagagcagaaaaccggtctgactaaaatttactaggcaggaatttcctcatcctaataggcctgggagtgctacgggagaccggggcttatttcatcccttatctgcaaccgtctaagacagacactcccagagtggccattttagagacctacccctgggaatgcattctctttctcagggctgttccttg

SEQ ID NO: 289804 - DNA, 782 bp, Homo sapiens
tgatggcgagaaacgctgcaggacccggctctggctcctcctcaaccttccctcgctgacgctaagatagcagcgtctccgaagagacagcagcacgagcccatttactgaattcaaccctaccccgcagaaccgcctcccgttatcgtttagacagtggctgactcaccctctctcactcccgcgtcctttctccgcgtctgctcgccttcacaggacccgctggcttggagccgcagaagccgctactgcagcgtgggcgacaatgctaggcgcccaggagaactaccgctcccaggttgcctttcgcgccccgagggctgctgggactctcggactcccgggccgagaccgagggaaagaatccgctttgcatgtcgggagtagtagtttgtgtaatatcgcgatccttctctggtgttccttgttttagctgacgacactcgagagcgccaattttcctagattcgattttgtggtttggaactgtggttttggaatccagagtagtcgcctcgttctattgagatggggtttcgccacgttggccaggctggtctcaaaatcctgacctcaggtatccaattgctccagcaccaactggtgaaaagaccatcattcttctactcagttgcatttgaagctttgtcaaaaaccagttgagtatattggtgtggatgtgtttctattctgtggatctctcttccgttccattgatctatgtgtctgttcctttgccagtactacactgggttgactaccatagcaatgaaataaacctt

SEQ ID NO: 289805 - DNA, 877 bp, Homo sapiens
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccacagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggtaacagtaacacttgttggcccatcttcatcaatattttgtcatctttaaaacatctctaaaggtcacttgcataacattttctttgtatttggatacttctttatccttgttctctctag

SEQ ID NO: 289806 - DNA, 344 bp, Homo sapiens
tagattgagaggaatatccgacagattagggggaaaaaggggctagctgcagagactctcttattttccccgctcatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttg

SEQ ID NO: 289807 - DNA, 298 bp, Homo sapiens
agcattcaattgtttgtctgttttccacaatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttg

SEQ ID NO: 289808 - DNA, 1355 bp, Homo sapiens
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccaggcccgtcaaactctttttggtgtttaggcgctcctcctccgggcggtgtgttgggagggcccaggtcaaggcgcgcgtgggcggaagcggcggcggtggcgaaggcggcggctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgtgttttatgttatttttgctccaggttaaaggtgcaatgctttcctcctcttttcttgtgaaggatttatcttgtttgaaaactagcaatagctttcttattctttttagattttacaggaaattttgtattgggatactaggcacaatttccatctgcataacatgaatatatattatctatgt

SEQ ID NO: 289809 - DNA, 2039 bp, Homo sapiens
tggtctcgaactcctggcctcaagcagtccctccacctcggcctcccaaagtgctgggattacaaacatgagccaccgtgcctggccctgatttacaaattaataaaatatcttatgattgactattccttactattccctccctaaaataaataaatatatacctgccagtaccctgtgtatcttttattgggaatttggaaccaggctgaagatgaaaggagaaagcaaaggtttaaaggtagacattagaccatactgtagctatttcatcagtgtaataaaggccacataaactaggctatatatataatataggttatatttaattcagatgatagtgattttaccacttcatataactgttctgaaatggtttttaaaatttattgcttttggaatcaatttttcttttgaaatcttttgaccttttaataacattattaaatagattgtaagttctttgaaattaggcgtataatctacaaattatttggttagaacaatgccttatgtagaatttgtgcctgataaattaattggtttgattatgttgttatgcattccaatatactttgagaattttaaattgtttttttctttaaaaaaaaactggagacttcataaaacatctttattatacataattttttagggagtgtatatatatatacacaattttttaaacaagaatttgatcatactgtaatactgttttataacttgcttttttcacttatcagaaacgtattacataccagtaagtatatatttgatattatttaatggctgcatagctttccattatgtagtattgtatttcaccaataaattattgttagaaatttaatagtttttcttctttttcactattttaataaatactgcaaggtacatcattgtagctaaatctttgtaaatatccttaattatatataattatgtacaattatatgtaaatatataaactcctagaagagaagttgctggataaaatagtttgcatgtttttaaggcttggatatttatttattgccaaattgctatttataaagattgtactttcacctgtaatttactattgtgcccatttctctggatgtttgcaaatagtgggtactataagagtggtttttttttagttcaggaaactaaattctgtagcttctgataaatgcatgagttgtgctccacatttctcaattgctgactgaaactgcatgattaaacataaatacagccagagctgcagaggagcatggaacctggagaaacagatgagataagcttctttagtctctatctgtgaaatgcttactttattctagtctcaattgaataaagtgttaagtgttagttctaacaactgaataagttaaatggcccctacttagagcctggaaattacaaataatcagatattcaatttcctaagttttcagagatttacgggttacacagtacagcaattcatttgattacccagatatcattcttaaatatctagtactaagcttttcttaaatttcccttcaatttgttgtttctttagaagactttaggtgttaaaatttagctttgttgtcttcatttaaaaagttgagtataggcattttttccaatgaatacctttattcttattacaggccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttg

SEQ ID NO: 289810 - DNA, 1101 bp, Homo sapiens
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccaggcccgtcaaactctttttggtgtttaggcgctcctcctccgggcggtgtgttgggagggcccaggtcaaggcgcgcgtgggcggaagcggcggcggtggcgaaggcggcggctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttg

SEQ ID NO: 289811 - DNA, 930 bp, Homo sapiens
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccaggcccgtcaaactctttttggtgtttaggcgctcctcctccgggcggtgtgttgggagggcccaggtcaaggcgcgcgtgggcggaagcggcggcggtggcgaaggcggcggctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgagtcctcctcgccatcctcatcacagcctcattctagccactgcagaacgaaggcctcatcattgtgtcaccatgcatccctgccctgggtcaaacgtaaccatgtaggccctgcaa

SEQ ID NO: 289812 - DNA, 397 bp, Homo sapiens
tgtgaatattatcaatgtacacatatagaactatggcatataacctgatacttggttatatatttccactttacctgcttttaaccaatattcatacatgatcctttgctagatagattatggttattaaaaatagtagaccatatgaattacaagcatgaccatacgttgcttttaagaataaatgatcacccagtaacgtggtctaagtaaaatattctcttttttaattatgtagtcctcctcgccatcctcatcacagcctcattctagccactgcagaacgaaggcctcatcattgtgtcaccatgcatccctgccctgggtcaaacgtaaccatgtaggccctgcaaaggctaccagtccatctctccgtcttcgtcgctggcgacccttc

SEQ ID NO: 289813 - DNA, 1160 bp, Homo sapiens
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccaggcccgtcaaactctttttggtgtttaggcgctcctcctccgggcggtgtgttgggagggcccaggtcaaggcgcgcgtgggcggaagcggcggcggtggcgaaggcggcggctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttg

SEQ ID NO: 289814 - DNA, 965 bp, Homo sapiens
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccacagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttg

SEQ ID NO: 289815 - DNA, 1441 bp, Homo sapiens
  misc_feature (1369)..(1369): n is a, c, g, or t
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccaggcccgtcaaactctttttggtgtttaggcgctcctcctccgggcggtgtgttgggagggcccaggtcaaggcgcgcgtgggcggaagcggcggcggtggcgaaggcggcggctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgggcaaaaaaaaaagaaaaacaaaaacaacaatgtgggcggcgcccggccagaaattttcaccatcctgggcgcggggaccagataaggaactgccaaagtcgccaggacaccggcgaagtgtcggtcccccaaaagaacgcggggccggggtcgaacaaccagagcgtcggctccggtcccgggcccgctatcccccgcgccggctggnacacacaccacacacgagcaacacacgtccaccatgacaacaccacgagcgaaaccattgaacaaacgcacg

SEQ ID NO: 289816 - DNA, 1072 bp, Homo sapiens
gcgcatgcgtagaacgcgagcgctcggcaaggctcggctcggaagagtccaagcgtgaggggagagggctgtggattcagatactgtttttctcccgaaataggaaattggcttatttttttctcctcggcagcatcttaatttaaaatatgacacttgacctacggccctgcacggagcggttaagagggtcaccaggcccgtcaaactctttttggtgtttaggcgctcctcctccgggcggtgtgttgggagggcccaggtcaaggcgcgcgtgggcggaagcggcggcggtggcgaaggcggcggctgtcagagctggagggccgggcaccgcggccatggagggtcaacgctggctgccgctggaggccaatcccgaggtcaccaaccagtttcttaaacaattaggtctacatcctaactggcaattcgttgatgtatatggaatggatcctgaactccttagcatggtaccaagaccagtctgtgcagtcttacttctctttcctattacagaaaagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttgaatctggatcaaccttgaaaaaattcctggaggaatctgtgtcaatgagccctgaagaacgagccagatacctggagaactatgatgccatccgagttactcatgagaccagtgcccatgaaggtcagactgaggcaccaagtatagatgagaaagtagatcttcattttattgcattagttcatgtagatgggcatctctatgaattagatgggcggaagccatttccaattaaccatggtgaaactagtgatgaaactttattagaggtaacagtaacacttgttggcccatcttcatcaatattttgtcatctttaaaacatctctaaaggtcacttgcataacattttctttgtatttggatacttctttatccttgttctctctag

SEQ ID NO: 289817 - DNA, 1590 bp, Homo sapiens
agccagagctgggcggtggcgggcgctgctgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaaccaccaaagaaaccatctaattggagaaggaaacatgaagaattcattgctaccataagagcagctaaaggccttgatcaggccctcaaagagggtggcaaacttcctcctcctcctccaccttcttatgatcctgattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttgtctccctctcataaagggatagcagcccctcatgcaggagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgataccccagactgtgtcattcaaggaaatattcacttatctgtcagaaaataatttcaaatggaacaattaatttaggtgttacttttctgttgttgttaaagcacgttaagtacatttccacaaactctcatactctagtgcttagcccttcaagctttaggataagtataactttgagcaaaaaatttggataaacatttgtattattggtgcctatcttcagatagtatcatagtaggatagatgctgggaattttgtaattaaagagaacagttttagttaccattaggtatgttaaggtcactcctgtagagcatgtcaacaaattatttcataaatccgaaa

SEQ ID NO: 289818 - DNA, 1249 bp, Homo sapiens
agccagagctgggcggtggcgggcgctgctgaaggagtctcgctgagctcgaggaggtggcgcgatggagggactggaagagaatggaggtgttgtccaagttggagaattgttaccttgcaagatttgtggaagaacattctttccagtagcattaaaaaaacatggacccatttgccagaagactgcaactaaaaaacggaagacttttgattcaagcagacagagagctgaaggaactgatattccaacagtaaaacctctcaaaccgaggccagaaccaccaaagaaaccatctaattggagaaggaaacatgaagaattcattgctaccataagagcagctaaaggccttgatcaggccctcaaagagggtggcaaacttcctcctcctcctccaccttcttatgatcctgattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttgtctccctctcataaagggatagcagcccctcatgcaggagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgatacccc

SEQ ID NO: 289819 - DNA, 1657 bp, Homo sapiens
gtggcaacaacagtagtaatagtattagcatcagctatctaaatgtttatatgaattgtactttttttctcataacctttctataagtgatcattttataaatgatgagactcagacttgctgtcacaaagctgtcagtagcattagcatttgaatctaaattcatttgaattcccaagcctctgcttttagtgttatatcatcatcatttagttttctaacccttctttgattcttaaagtttcaaaatggagactcatggatgatccaaccagaagtccctctgatttcggatagcccaggctgtgcagttggtaaaattaaatctttaaagggaatattatattaactcatttattttagttgctgctttttagaactttcataagttgaatattattctttaatgtgactagcaaaaaaattctttttttaactacatcgtatatgcctagaataatgaaacttgtttgtttatttaaccattatccgtaagcatttatcagaatatatgttttgagggaaatataaatttaaactgtttttaaaaatgtatctttcagaatgattaccttataaatttcatgtaaagcatatatacatattttagttgattttatttactatcagaatagtattagtaaatgcaaaattatttggtttatctttaatattaactactatttgctttcagatttaaaataattattgggactttaatcttttgaacttctctgaagcttctaagtattctttctagtcatgtgaataggtaatttgagaaatacatgctcactgttcaatacttttccattatttttcctcttttttatagagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgataccccagactgtgtcattcaaggaaatattcacttatctgtcagaaaataatttcaaatggaacaattaatttaggtgttacttttctgttgttgttaaagcacgttaagtacatttccacaaactctcatactctagtgcttagcccttcaagctttaggataagtataactttgagcaaaaaatttggataaacatttgtattattggtgcctatcttcagatagtatcatagtaggatagatgctgggaattttgtaattaaagagaacagttttagttaccattaggtatgttaaggtcactcctgtagagcatgtcaacaaattatttcataaatccgaaa

SEQ ID NO: 289820 - DNA, 1013 bp, Homo sapiens
agccagagctgggcggtggcgggcgctgctgaaggagtctcgctgagctcgaggaggtggcgcgatggagggactggaaggtgaggcgatgaagggatgagggcaggacggctagagcgggcccgaaacagctggggaccctggacaccagtagcaggaaggcgagggctggttcggtgcggcggacctcgcgcgctcgccgcgccttccggaggctgggggcataggaaccggacagtccccgatgcggtggagctaacgctaccaggctgccccgcctcagacggtcttcaactgggctttcccgcccggagccagatcctgcccctggcaagacgcctgcacgtctcttcctaccattttctgatcttgcttgactcctgagtgcccttttagtgatcccagtctctggccagattttgttttccttgtactggactctctccattattgtccacggccttaacaccaacaggccactttgtgctgcagccccggggtgtgtctccagcctcgagctcctgacattccttggccgatttccctaggtaaccggctttttacatttcgacagcatcttctgtcggagggatgtcagagcatctcctaaggaagtgtcactggccagctttagagccggtacaatagattacccggaggatttgatgacttattcacggccgctgtgtgaggaagagcctgtattggttccttatctttgggtttatctttgtactgtaaccatgactccagattttgctttgttcccagttctttcactttttctctattctgtttacccattttatcctgtgtaatgaaagcattcacctaaaaacaaaggaaggacaaaaaccacaataactagcattggcaacaacagtttcaagattttttaatttgttatgatgaagaacaaaccttcagaattgaaagatcctattgtcttgatttagctcctttcccccgtctcctagtttacacggattcagttggaattaagaatgagcaga

SEQ ID NO: 289821 - DNA, 1545 bp, Homo sapiens
gcctaggtaaggatcctggtcgtgactaggggctctgtgagttctcatccagtgaaaaaacgcttccgtgtgcgcagaccggcagtcgttctgaacatagagtccacgatggcgttcatgaggtgccattatctggatctatcagacatggagtcctaagcggagctccgatatcatagattacagccttcgccgtacttctgaacatgtaaaacctctcaaaccgaggccagaaccaccaaagaaaccatctaattggagaaggaaacatgaagaattcattgctaccataagagcagctaaaggccttgatcaggccctcaaagagggtggcaaacttcctcctcctcctccaccttcttatgatcctgattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttgtctccctctcataaagggatagcagcccctcatgcaggagctaatgtcaaaccccgaaattccacaccacctagtttggcaagaaatcctgccccaggtgtgcttacaaacaaaagaaaaacatatactgagagctacatagccaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgataccccagactgtgtcattcaaggaaatattcacttatctgtcagaaaataatttcaaatggaacaattaatttaggtgttacttttctgttgttgttaaagcacgttaagtacatttccacaaactctcatactctagtgcttagcccttcaagctttaggataagtataactttgagcaaaaaatttggataaacatttgtattattggtgcctatcttcagatagtatcatagtaggatagatgctgggaattttgtaattaaagagaacagttttagttaccattaggtatgttaaggtcactcctgtagagcatgtcaacaaattatttcataaatccgaaa

SEQ ID NO: 289822 - DNA, 681 bp, Homo sapiens
gcggccgcctactactactactgctcgaattcaagcttctaacgatgtacggggacatgagtgtgggactaaataccctgtagaatgggccaaattttgctgtgaatgtggcattcgaagaatgattctatgaatagaatctcaaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgataccccagactgtgtcattcaaggaaatattcacttatctgtcagaaaataatttcaaatggaacaattaatttaggtgttacttttctgttgttgttaaagcacgttaagtacatttccacaaactctcatactctagtgcttagcccttcaagctttaggataagtataactttgagcaaaaaatttggataaacatttgtattattggtgcctatcttcagatagtatcatagtaggatagatgctgggaattttgtaattaaagagaacagttttagttaccattaggtatgttaaggtcactcctgtagagcatgtcaacaaattatttcataaatccgaaa

SEQ ID NO: 289823 - DNA, 337 bp, Homo sapiens
attcgcggccgcgtcgaccaggtgtataagccacccgcacttaaaaagtcaaattctcctggaactgcatcatcaggatcttcacgattaccgcagccaagtggcgctggcaaaactgttgtaggtgttccttcaggtaaagtgtcttcaagtagcagctctttgggaaacaaacttcagaccttgtctccctctcataaagggatagcagcccctcatgcaggagctaatgtcaaaccccgaaattccacaccacctagtttggcaagaaatcctgccccaggtgtgcttacaaacaaaagaaaaagtcgacgcggccgcgaatttagtagtagta

SEQ ID NO: 289824 - DNA, 288 bp, Homo sapiens
atgttgtattctcaacatgggatgtgcatctaagttatgaagcataacaattaaataacatccataaacccatgacctcatgcagtatgaaacatttctagtcctgtggaagctacaggactgctggaatttcttctctgatccagtccccttgcttcgcaacagaggttcctgcttctccacgccaatgacatggtgagagaatacagggggagctgaagacaaacaacataaacttatgtttgcaaagcaccttttactctgtgaaataaagtgagtgcaagcagt

SEQ ID NO: 289825 - DNA, 870 bp, Homo sapiens
cagaaacagaattccactcttaaccccctcagtttgcagaatgtctaagtgtagtgactctagactcaatgtgagatgaaaagggaaaaaagaaactgcgtataaatagtactagagatttgggttataggattggtaattcagcgtgaagttcacggatgcctcttcaagaaacagaagcttcactcaatctggctttcaaaatggtgagaaaagaagtggactcacataattgaagaggcttgagttctggaagcttagaagtccatgactggggtcccagcatgcttggattcaggtggccttcagacacttcttccacaaggaaattgggcagcttcctgaaatgaacaacccgtaaagccatgggaattatggatcagctcccagaccttccgcttcatgactgcaagcctttgtgaaagtttctgacctctttatgcttcaggaatcttagcaatgaaacaaggataatggcacttgctgtgacgatcatgcttccaacagttcaaaaagccaagggaagatcagaagcttatcttccagccaactggggtgggttggtgggggttggtggaatttgacagaagcttgtaatcagccacattggaggatgaggggaaggcctgtcatctgttttgaaacgtgttacgacaagatgttacatttctggaaacctgggtgcagaaaaagatgcacttttctgagagtttgtgcggattgagtgaatctgcttcatttcagcccgaagttgctggagggtccttcgtcaggagacagtatatatagacttgccagaagtgcaataattattcagtctctttctcagtattaagccaatgtacaaaataattacacatctgcttctat

SEQ ID NO: 289826 - DNA, 695 bp, Homo sapiens
gccaggaaaaaaatcaaggaatggataatataagagcctttcaagaatgtagatttacactagagatttattaaatttgagggcctataacaaaattaatttatttaaacaaatatttgttaaaaattcttttataaagtacctgccactgtgttaggtgttctggggaatctgagagaaatagaaagacactagaataatatggttggtctaaagcactcaagatttagaatcaatggaggcttgtgttcaagttgagattttaccaccacttatcagctgtatcctctggttttacttaattgtaggtctactgatcactgccttccctgctctgccatcatacaaattatctcataggattgttttgaggattaaacaaaacaccaaccacgggtcacagattatgacattttcaagaaggacacgtttgcttcccctgccaccattgtaagtttcccaatgcctccccagccctgcagaactgtgagccagttaaacctctttcctctataaattacctagtctcgggcagttctttatagcagcatgagaatggactaatacagtaaactggtaccacagagagtggggtgctactgtaaagatacatgaaaatgtggaagttactttggaactgggtaacaggtagaggttggaacagtttggagggctcagaagacaggaaaatgtgg

SEQ ID NO: 289827 - DNA, 784 bp, Homo sapiens
tgatggggtgtgataggtggcagcattataagaaaatgtttacaaattaaaaacagtcccctctagaaagcaaacaggtagggcaggggtgattcttttcacttataagcccttctctactatttacttttcaaaaacatgaacataaattattctgatagaaagtaaaaataaaattgcatttttaatgtgtgaacatatgaaatacttgtactaataagaaattattactgaggtcaatctaagatagttctagagcagcaaatcagatggctgaactctagcctcatccaaaagcagccacccctagacaatgagagccatggccctcctaatgggccacctggccacccagagagtgacagataaatgccaatggttgaagaggcacaaagtacctatgtatgggtggagcacaaagtatccatgtggggaggagaagcacttgcttcttatttataagggtgcactaaagatttttaagttcaagccagttttaaaaagaagtttcccttctttcgttgtgccctctctacagtcattctgcaaaatctacaagtggatagcgcaccaccactacctgggcccactgtgtccctgcaagaaagacaacgtgaaagaaggttcttgtatgcaaaggtgctttgctccttctgacagtttttcaaagtcaaacagaaagtacttctggtgaatcacaatttagtgtcatctgcatgtttttctttcataactgaggatggattatcattaaattgtatagaagttgtttcaagcaacagga

SEQ ID NO: 289828 - DNA, 733 bp, Homo sapiens
aaagcagcacatgtccaacaggaaaatgaataaacaaatacagcatattcatacaatagaatcctatacagagcaactaaaataacagctagaggcaacaacacggatggatcttacaagcctgatgtggaacaagagaagcctgtccagagactaagtgaatggatttatgtggtatgcaaaaacaggcaaaaccaaatcatagtgttttgggaggtatgcttacatagtaaagctctgaaggaaaacaaagaaaaggcgactaaagagaatgacaacttacacaatgcagaatcctggattggatcctagatccaatcaacgtgtagggatgctgatcccactccaagtctagaacatcattcacatcttggacagcaaatttcacatactgatgaaggcgccgaatttcctataagaaaaaaattaaaaggcaaataacttgtttttctgatagtttgggggaagatgtatcaaaacagtcaaaagaattctaaaatacttctatattaagaaccataatgaacaaggaaaacagaataggttttaatacgatttttaaaactatataattaaaatgaggccgggtgtagtggctcaggcctataatcccaacaccctgggaggccaaggcaggaggactgcttgaagccaggagttaaagatcagcctgggcaacacagcaagactctgtctctaataatgtatacaaataaaaaagttacataaaaaa

SEQ ID NO: 289829 - DNA, 679 bp, Homo sapiens
aaagcagcacatgtccaacaggaaaatgaataaacaaatacagcatattcatacaatagaatcctatacagagcaactaaaataacagctagaggcaacaacacggatggatcttacaagcctgatgtggaacaagagaagcctgtccagagactaagtgaatggatttatgtggtatgcaaaaacaggcaaaaccaaatcatagtgttttgggaggtatgcttacatagtaaagctctgaaggaaaacaaagaaaaggcgactaaagagaatgacaacttacacaatgcagaatcctggattggatcctagatccaatcaacgtgtagggatgctgatcccactccaagtctagaacatcattcacatcttggacagcaaatttcacatactgatgaaggcgccgaatttcctataagaaaaaaattaaaagtcattctgcaaaatctacaagtggatagcgcaccaccactacctgggcccactgtgtccctgcaagaaagacaacgtgaaagaaggttcttgtatgcaaaggtgctttgctccttctgacagtttttcaaagtcaaacagaaagtacttctggtgaatcacaatttagtgtcatctgcatgtttttctttcataactgaggatggattatcattaaattgtatagaagttgtttcaagcaacagga

SEQ ID NO: 289830 - DNA, 504 bp, Homo sapiens
atctcagagaaagaagcaccaagtcctctggggcgataagtgatggctacatattgaagaagtgtaaacttccagaaacaaaacagacaacactttgtgatgataaatgtcacagttgccacacaggccagcagaaacccaatcacatccaaagagtggtactggaaccaggtgaggtcacgggctgcaactcgaaggtgtttggctcctttgtggcgcatgacaaattcaatccagaagactgctcgatccaggggcttcactggttgatcacgttgaattcttgataatttcataacattctctttatatctgaaggataaaaataaagataccaacactgaaagcacctatgatgttgagacaagttcccccaggaagctttactgagttgcttgtcataaggcagacatcgtctgctctaataggtgtaagtcaaacattctgaatgaagactatagactcatttctactgaaacttcgaagccaacaaaataaaaccaa

SEQ ID NO: 289831 - DNA, 416 bp, Homo sapiens
ttcctccttgagaagattccaagactcaacgaattaaattagtcttaatatagcaaaatttaaatggaaaatagaaaacacacatttaggttatactcaactttagtaaataatattacatttggggaagtacaaaattctttttggatatgtactattaagcaaaatatgaaaataactggttaaatgacaacctagtgattctttctacaccattagattatctaccttctatgctggaaatagaatataaccttaaccctagctaatttattttaaaataaatatagctctctgaagtaatttcatacatagtatcttataagagaacatgaaaaacatttattatcccataaaatccatggggtaataatgtcaatttaagactcaggtggtgtgggtccgagctgattgtg

SEQ ID NO: 289832 - DNA, 2514 bp, Homo sapiens
  misc_feature (914)..(914): n is a, c, g, or t
  misc_feature (1587)..(1587): n is a, c, g, or t
ttcctccttgagaagattccaagactcaacgaattaaattagtcttaatatagcaaaatttaaatggaaaatagaaaacacacatttaggttatactcaactttagtaaataatattacatttggggaagtacaaaattctttttggatatgtactattaagcaaaatatgaaaataactggttaaatgacaacctagtgattctttctacaccattagattatctaccttctatgctggaaatagaatataaccttaaccctagctaatttattttaaaataaatatagctctctgaagtaatttcatacatagtatcttataagagaacatgaaaaacatttattatcccataaaatccatggggtaataatgtcaattaatgatagtttcaggaaactccctttaaaaacagatctaagaattttacctaatatattttgagccaagaattaacaaatatgaaatttgccattagagaatgacagacttttctgtgcaaaaaaaaagtgcagaagatgttgtccctcctgaaactatggaattcctttatcttctaaaacttatctaaaaatcttttagtagcaggtaactaaactgtcctatatgcacctatcatgtactatcagttgactgtaaattcctgattttgatattaagtagtaaatgaaaatggtccattcgtgcaaattttggtaagacaacatttaaacatacagaagtccaaaataaccttcaaggtgtttaacattttacaacttaaaggaaaacaagtccattatataaattttagtaagactcataactacatgtaaaaactgtacaggaggattatggattgtatagaaactgatacacaacagtggtatcagtttttctcaagaacgttaatattttcacaccactattaacancacaaacaaaagttcagaaattatcacattttatttttgaaaagttgctgcttaaaaaaaaatctaactataaccacatttaaactgaaaaacaaattacaactgctgcttctgtttagcagcagcacataacaacacattcttcttccccactgtgctcatggggtatgctataacctcagtaaaattcctcctagggtacacattaaaaagaagagaactggtggaaattcattccacaatctgaacaaagtaaaagtaaatttggtgtatgttaatgagtacaccatatcaacttagaaaaattgtgttaatgagaaaaggggagattcaactccttgagtagctctatatacttaaaatataaagccaccattgtatctaaaattgagtctgaaatatggataacaaaattgaccacagctattttccatcacatattgcagcttttaaaaagtacacaattgttaagtttgcattagaaatataagcagattacctactagttgaaaccatatagtattgttactaagctgatttttttaaaaaagtacaaagaaacatacattttcattcatttggaaaatgtaaaaatttaagtactaatatataatctcttcactttctctgatctacaaatggatagaatgcctagttatcgtcatgcagatanattcttcagaattccgtgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaaaaattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggt

SEQ ID NO: 289833 - DNA, 3410 bp, Homo sapiens
  misc_feature (1810)..(1810): n is a, c, g, or t
  misc_feature (2483)..(2483): n is a, c, g, or t
ccgctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaagacagatgcaccatcaggaatggaattacagtcatggtatcctgttataaagcaggaaggtgaccatgtttctcagacacattcatttttacaccctagctaatttattttaaaataaatatagctctctgaagtaatttcatacatagtatcttataagagaacatgaaaaacatttattatcccataaaatccatggggtaataatgtcaattaatgatagtttcaggaaactccctttaaaaacagatctaagaattttacctaatatattttgagccaagaattaacaaatatgaaatttgccattagagaatgacagacttttctgtgcaaaaaaaaagtgcagaagatgttgtccctcctgaaactatggaattcctttatcttctaaaacttatctaaaaatcttttagtagcaggtaactaaactgtcctatatgcacctatcatgtactatcagttgactgtaaattcctgattttgatattaagtagtaaatgaaaatggtccattcgtgcaaattttggtaagacaacatttaaacatacagaagtccaaaataaccttcaaggtgtttaacattttacaacttaaaggaaaacaagtccattatataaattttagtaagactcataactacatgtaaaaactgtacaggaggattatggattgtatagaaactgatacacaacagtggtatcagtttttctcaagaacgttaatattttcacaccactattaacancacaaacaaaagttcagaaattatcacattttatttttgaaaagttgctgcttaaaaaaaaatctaactataaccacatttaaactgaaaaacaaattacaactgctgcttctgtttagcagcagcacataacaacacattcttcttccccactgtgctcatggggtatgctataacctcagtaaaattcctcctagggtacacattaaaaagaagagaactggtggaaattcattccacaatctgaacaaagtaaaagtaaatttggtgtatgttaatgagtacaccatatcaacttagaaaaattgtgttaatgagaaaaggggagattcaactccttgagtagctctatatacttaaaatataaagccaccattgtatctaaaattgagtctgaaatatggataacaaaattgaccacagctattttccatcacatattgcagcttttaaaaagtacacaattgttaagtttgcattagaaatataagcagattacctactagttgaaaccatatagtattgttactaagctgatttttttaaaaaagtacaaagaaacatacattttcattcatttggaaaatgtaaaaatttaagtactaatatataatctcttcactttctctgatctacaaatggatagaatgcctagttatcgtcatgcagatanattcttcagaattccgtgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaaaaattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggt

SEQ ID NO: 289834 - DNA, 980 bp, Homo sapiens
ttttgtgctcgttgtgtggctgtgagaggactttgcagtttctctgtcttggggactctggcttcgggtcatagtgtggacaaagcaggcttgttacctgtctgccctgttattttttcggtcttatgtttgctggcttgttgctgaatctggccgggggagacggatgaagggggtgtccgggctaactttgcaccgcagggccccgccaggatctccccttccctgtgaaggaccctatacctggtgtatggccccgccccggctccggctgtactaagcgctgctgttggcctcaccctttggatggaacttgcagcggccgggacagagttgcggtttggggcaaatcaagttgggttgggggctctggaagaaggtgaggagtctatggagcataaaagcaaggagcagcggctgaggctctgggtgcagggtgtggttcacgaggtcaccaaggagccctgggactgaagcccctttccctagaaccccggctctacgtctcgaagttctggagggtgccgcccctccgcaccacgtcactgcaggctctagctgctcttccaggctttctgctccctctgctggccgttctcacacatgacacccgctcggagtcgaagcagaagagctggggaactgaaggaggagcccagttgaaggaggagcccctcactaaagcccacttaaaagcccaggagaaagtataagccaggcgcggtggctcacgcctataatctcatcacttcgggaggccaagtcgggtggatcaagaggtcaagagattgagaccatcctggccaacatgttgaaacctcgtttctactaagaatacaaaaattagtgggcgcctgtaatcccagctgctcgggaggctgaggcagaagaatcacttgaacccaggagacggaggttgcagtgagccaagatcgtgtcactgcactccagcctggtgacagagcgagactcgatctcaa

SEQ ID NO: 289835 - DNA, 2797 bp, Homo sapiens
ctcaggcgggcgcggagccgcgcggagtgacaaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggaatctaatgaccattgaactgtggccatgacttcaattacaagtattttcttcactaatgtcagactgtgggcctttgtatatacacttttaacaaactttttggaagtgcaatacatatcgcaacaacttctcaatgctgaatcatagtattggaagacattttaagcaacaattaaactcaacttatttactaccaataatgtacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttccacaaatattctttcttctgtccttctggaactcaagagtaaacatatattagattttctcaccatttcatgcatgctggttcctaggctactctctgagtcattttttttttcttatctgccctccagttcactagttctgtcattttctgggtctgatctgctgcaaatgcaatacattgagttttaaatttcagtcattgtgttttcatttctagaaatttcatttgactctttctcaaattacttttccattttttttgtagtttcctatccctggagatattttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatcttgtcagcttagtgctttaagtgattgcatttaaaaaaattctgcattttcagtttttagcaggaggaatggcctcaactagtggttttcaactggggatgatttttttcccctaggggacatttgataatgtttggagatgttttagttgttagaactggggttgggggaactactgtcatctggtggggagagaccggcaatgctgttgatcttactataatgcacaggccacccccaacaacaaacaaattacatagccccaaatatcaataatgccaaggtccaaataacctaaccttccattactgaaaatagaagttcaagaagatagtttataatttaaaaatttttaggtcttaataagttgtcatactttcacaggttttatttcatactaagtaatttatttcaaattttacattccaattacagaaaattttctaagccagtttttgttccttcatgagtattactatcaaggtcacatttttcatctagtatgttttaccctggtacttgttggcagggtcaggactaaggtgagatgcgcaaggcatttgcctcacacaaaatgcacaatgaataaaatgtcaaaactttaaataaagacagaatcactaaaagtactttgccatattggaacctgaggcaaaaagaaaaataagtaataatatttaaaattttgatctcttgttcattgtagatttttacattaattttgattgtttaaaacattgcattaaaatattatttaatgtgattgctgagt

SEQ ID NO: 289836 - DNA, 1149 bp, Homo sapiens
  misc_feature (769)..(769): n is a, c, g, or t
  misc_feature (860)..(860): n is a, c, g, or t
  misc_feature (952)..(952): n is a, c, g, or t
  misc_feature (1135)..(1135): n is a, c, g, or t
ctcaggcgggcgcggagccgcgcggagtgacaaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggtgaaacagtcgcaaatggaattccaagaaacattctatatacactgcctctaggactgggacagatagccactgagtacctgcttcaaatcaccctgcacgttttctctttggaaagataagcactggagaaccntctcgttaccttcagcagaaatggaaacaaatcaagacattaagaatgccgcagtggacagcagttatgcaaggttcagcagaggaagttntcaagatggtgtgcctcactagccagaaatcagaaaagatcgaagctagccttttcatctcagctgctccttaaatcagtgcaacccctccnaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatcccncaagagcaataaat

SEQ ID NO: 289837 - DNA, 787 bp, Homo sapiens
ggcggggggagacgccgggggaggaaggcagccgggagaaggaaagctgggacgggccgggaccacaggagccccagccccacacagcaaccacccgggcgagaaagaaagaaagagccagggaggcgggcgaagcgcggggagagaagcagagaagaaatattcaccttcccgcctcatgcccactttgaggcacttcttgaggcggcagtattggcactggttgcggtggtgctggtcgatgggacagttcctgttggcacggcatgtgtaagttaagttcctgcggacgctcctcttgaagaaacttttgcagccctcgcagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgttatttcttccactgacatcttgaacccctcagtcatccatgaggcttggaatcaacttcttccaaaactcctgctcatgtgatattttgatctccttttatgaaacatggatgtttaatagctcttacatgggaaa

SEQ ID NO: 289838 - DNA, 641 bp, Homo sapiens
  misc_feature (261)..(261): n is a, c, g, or t
  misc_feature (352)..(352): n is a, c, g, or t
  misc_feature (444)..(444): n is a, c, g, or t
  misc_feature (627)..(627): n is a, c, g, or t
actggtaataatcatcttacagatgtaagctgccattcactggggagctttggcaatagaattggctagatcaggaagcctatgtcaactatggaacaacaacttgcagctcatctctattgatggtgaaacagtcgcaaatggaattccaagaaacattctatatacactgcctctaggactgggacagatagccactgagtacctgcttcaaatcaccctgcacgttttctctttggaaagataagcactggagaaccntctcgttaccttcagcagaaatggaaacaaatcaagacattaagaatgccgcagtggacagcagttatgcaaggttcagcagaggaagttntcaagatggtgtgcctcactagccagaaatcagaaaagatcgaagctagccttttcatctcagctgctccttaaatcagtgcaacccctccnaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatcccncaagagcaataaat

SEQ ID NO: 289839 - DNA, 3052 bp, Homo sapiens
agccttgcgcgcggggttggctgccgggaggtcgacgctagtgcggtcccccgcgcggcggaggggcccgggccgcggtatctgcgcactgagacgtcggcggaaggatagaggccgtgctctcgcccccgcagaaggccaccactccttgagaaggccggagggacaaagcaccgggcatgcgccgggggcattcaagaaggaagccaggcccgaccgggggtggcgcacgcttcccgaaccccaggcccacggcccggttccgcgcgggcagttggcgccccctcgggtcggcacagcagacctcttagtaatggtccccagggagtacagggactgagaaacggaaatactaccatcctccagccaatctgttgggaggactgcttgcagaggactcgtgctccagatgttgcactagaggcgctgcaagtgtgagcagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggaatctaatgaccattgaactgtggccatgacttcaattacaagtattttcttcactaatgtcagactgtgggcctttgtatatacacttttaacaaactttttggaagtgcaatacatatcgcaacaacttctcaatgctgaatcatagtattggaagacattttaagcaacaattaaactcaacttatttactaccaataatgtacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttccacaaatattctttcttctgtccttctggaactcaagagtaaacatatattagattttctcaccatttcatgcatgctggttcctaggctactctctgagtcattttttttttcttatctgccctccagttcactagttctgtcattttctgggtctgatctgctgcaaatgcaatacattgagttttaaatttcagtcattgtgttttcatttctagaaatttcatttgactctttctcaaattacttttccattttttttgtagtttcctatccctggagatattttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatcttgtcagcttagtgctttaagtgattgcatttaaaaaaattctgcattttcagtttttagcaggaggaatggcctcaactagtggttttcaactggggatgatttttttcccctaggggacatttgataatgtttggagatgttttagttgttagaactggggttgggggaactactgtcatctggtggggagagaccggcaatgctgttgatcttactataatgcacaggccacccccaacaacaaacaaattacatagccccaaatatcaataatgccaaggtccaaataacctaaccttccattactgaaaatagaagttcaagaagatagtttataatttaaaaatttttaggtcttaataagttgtcatactttcacaggttttatttcatactaagtaatttatttcaaattttacattccaattacagaaaattttctaagccagtttttgttccttcatgagtattactatcaaggtcacatttttcatctagtatgttttaccctggtacttgttggcagggtcaggactaaggtgagatgcgcaaggcatttgcctcacacaaaatgcacaatgaataaaatgtcaaaactttaaataaagacagaatcactaaaagtactttgccatattggaacctgaggcaaaaagaaaaataagtaataatatttaaaattttgatctcttgttcattgtagatttttacattaattttgattgtttaaaacattgcattaaaatattatttaatgtgattgctgagt

SEQ ID NO: 289840 - DNA, 2885 bp, Homo sapiens
cgcccgcgacccacacccccaccccaccgcacatacccacgccacgaacacgagaccaccgcacgcgccctaaagcgcagcaggcggagagagggagatagggcgagggaaggagaacgcggagagagacgaagggagtgggagaccagcgacagcgagcgccagggcaccgcaggcacactggatgcccagtccgccggcccagccgccctcggaccctggaccgtgcgtcgtgggcaccagaaacgagactcggccaaatcctgcctcaccagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggaatctaatgaccattgaactgtggccatgacttcaattacaagtattttcttcactaatgtcagactgtgggcctttgtatatacacttttaacaaactttttggaagtgcaatacatatcgcaacaacttctcaatgctgaatcatagtattggaagacattttaagcaacaattaaactcaacttatttactaccaataatgtacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttccacaaatattctttcttctgtccttctggaactcaagagtaaacatatattagattttctcaccatttcatgcatgctggttcctaggctactctctgagtcattttttttttcttatctgccctccagttcactagttctgtcattttctgggtctgatctgctgcaaatgcaatacattgagttttaaatttcagtcattgtgttttcatttctagaaatttcatttgactctttctcaaattacttttccattttttttgtagtttcctatccctggagatattttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatcttgtcagcttagtgctttaagtgattgcatttaaaaaaattctgcattttcagtttttagcaggaggaatggcctcaactagtggttttcaactggggatgatttttttcccctaggggacatttgataatgtttggagatgttttagttgttagaactggggttgggggaactactgtcatctggtggggagagaccggcaatgctgttgatcttactataatgcacaggccacccccaacaacaaacaaattacatagccccaaatatcaataatgccaaggtccaaataacctaaccttccattactgaaaatagaagttcaagaagatagtttataatttaaaaatttttaggtcttaataagttgtcatactttcacaggttttatttcatactaagtaatttatttcaaattttacattccaattacagaaaattttctaagccagtttttgttccttcatgagtattactatcaaggtcacatttttcatctagtatgttttaccctggtacttgttggcagggtcaggactaaggtgagatgcgcaaggcatttgcctcacacaaaatgcacaatgaataaaatgtcaaaactttaaataaagacagaatcactaaaagtactttgccatattggaacctgaggcaaaaagaaaaataagtaataatatttaaaattttgatctcttgttcattgtagatttttacattaattttgattgtttaaaacattgcattaaaatattatttaatgtgattgctgagt

SEQ ID NO: 289841 - DNA, 1664 bp, Homo sapiens
  misc_feature (1284)..(1284): n is a, c, g, or t
  misc_feature (1375)..(1375): n is a, c, g, or t
  misc_feature (1467)..(1467): n is a, c, g, or t
  misc_feature (1650)..(1650): n is a, c, g, or t
ctcaggcgggcgcggagccgcgcggagtgacaaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagaggtagggttggttttttaatactcgttctcactttaagtctcaccagggaggggtttgggaagcactgcgtgtttgggggacgttttgcgcttcctggtctctccagcctacaagtcgggagtcggcgaccgcttagtgacgagcgatgattttaaagagcagaataaaaggttttcccgtgcctgccccacagcccctccagctcgaataatggagaactgtcaatgcactccgcgagcggtggcccattgtacgcagctgatggcgaggaggcgactgggggtagcaggggctccttgccctcgtccctatgcccaaataaacgcgcaaacgcgctcccgtcttctggtcagttaaaaggtgaaacgaacacgattaaaatagaccaaaagaaaagaaagaaaagaaaacctttctatgtacagattctaaatcgtactccccatacagtcagaggcagggagtcgagggcagaggcagcaggcggagagagggagatagggcgagggaaggagaacgcggagagagacgaagggagtgggagaccagcgacagcgagcgccagggcaccgcaggcacactggatgcccagtccgccggcccagccgccctcggaccctggaccgtgcgtcgtgggcaccagaaacgagactcggccaaatcctgcctcaccagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatacactgcctctaggactgggacagatagccactgagtacctgcttcaaatcaccctgcacgttttctctttggaaagataagcactggagaaccntctcgttaccttcagcagaaatggaaacaaatcaagacattaagaatgccgcagtggacagcagttatgcaaggttcagcagaggaagttntcaagatggtgtgcctcactagccagaaatcagaaaagatcgaagctagccttttcatctcagctgctccttaaatcagtgcaacccctccnaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatcccncaagagcaataaat

SEQ ID NO: 289842 - DNA, 3472 bp, Homo sapiens
ctcaggcgggcgcggagccgcgcggagtgacaaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagaggtagggttggttttttaatactcgttctcactttaagtctcaccagggaggggtttgggaagcactgcgtgtttgggggacgttttgcgcttcctggtctctccagcctacaagtcgggagtcggcgaccgcttagtgacgagcgatgattttaaagagcagaataaaaggttttcccgtgcctgccccacagcccctccagctcgaataatggagaactgtcaatgcactccgcgagcggtggcccattgtacgcagctgatggcgaggaggcgactgggggtagcaggggctccttgccctcgtccctatgcccaaataaacgcgcaaacgcgctcccgtcttctggtcagttaaaaggtgaaacgaacacgattaaaatagaccaaaagaaaagaaagaaaagaaaacctttctatgtacagattctaaatcgtactccccatacagtcagaggcagggagtcgagggcagaggcagcaggcggagagagggagatagggcgagggaaggagaacgcggagagagacgaagggagtgggagaccagcgacagcgagcgccagggcaccgcaggcacactggatgcccagtccgccggcccagccgccctcggaccctggaccgtgcgtcgtgggcaccagaaacgagactcggccaaatcctgcctcaccagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggaatctaatgaccattgaactgtggccatgacttcaattacaagtattttcttcactaatgtcagactgtgggcctttgtatatacacttttaacaaactttttggaagtgcaatacatatcgcaacaacttctcaatgctgaatcatagtattggaagacattttaagcaacaattaaactcaacttatttactaccaataatgtacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttccacaaatattctttcttctgtccttctggaactcaagagtaaacatatattagattttctcaccatttcatgcatgctggttcctaggctactctctgagtcattttttttttcttatctgccctccagttcactagttctgtcattttctgggtctgatctgctgcaaatgcaatacattgagttttaaatttcagtcattgtgttttcatttctagaaatttcatttgactctttctcaaattacttttccattttttttgtagtttcctatccctggagatattttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatcttgtcagcttagtgctttaagtgattgcatttaaaaaaattctgcattttcagtttttagcaggaggaatggcctcaactagtggttttcaactggggatgatttttttcccctaggggacatttgataatgtttggagatgttttagttgttagaactggggttgggggaactactgtcatctggtggggagagaccggcaatgctgttgatcttactataatgcacaggccacccccaacaacaaacaaattacatagccccaaatatcaataatgccaaggtccaaataacctaaccttccattactgaaaatagaagttcaagaagatagtttataatttaaaaatttttaggtcttaataagttgtcatactttcacaggttttatttcatactaagtaatttatttcaaattttacattccaattacagaaaattttctaagccagtttttgttccttcatgagtattactatcaaggtcacatttttcatctagtatgttttaccctggtacttgttggcagggtcaggactaaggtgagatgcgcaaggcatttgcctcacacaaaatgcacaatgaataaaatgtcaaaactttaaataaagacagaatcactaaaagtactttgccatattggaacctgaggcaaaaagaaaaataagtaataatatttaaaattttgatctcttgttcattgtagatttttacattaattttgattgtttaaaacattgcattaaaatattatttaatgtgattgctgagt

SEQ ID NO: 289843 - DNA, 2746 bp, Homo sapiens
ctcaggcgggcgcggagccgcgcggagtgacaaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagaggtagggttggttttttaatactcgttctcactttaagtctcaccagggaggggtttgggaagcactgcgtgtttgggggacgttttgcgcttcctggtctctccagcctacaagtcgggagtcggcgaccgcttagtgacgagcgatgattttaaagagcagaataaaaggttttcccgtgcctgccccacagcccctccagctcgaataatggagaactgtcaatgcactccgcgagcggtggcccattgtacgcagctgatggcgaggaggcgactgggggtagcaggggctccttgccctcgtccctatgcccaaataaacgcgcaaacgcgctcccgtcttctggtcagttaaaaggtgaaacgaacacgattaaaatagaccaaaagaaaagaaagaaaagaaaacctttctatgtacagattctaaatcgtactccccatacagtcagaggcagggagtcgagggcagaggcagcaggcggagagagggagatagggcgagggaaggagaacgcggagagagacgaagggagtgggagaccagcgacagcgagcgccagggcaccgcaggcacactggatgcccagtccgccggcccagccgccctcggaccctggaccgtgcgtcgtgggcaccagaaacgagactcggccaaatcctgcctcaccagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgatggaatctcgctatgtcaccaggctggagtgcagtggcgcaacctcggctcagcgcaacatccgcctcccgggttcaagtgattctcctacctcagcctcctgagtagctgggattacaggaatctaatgaccattgaactgtggccatgacttcaattacaagtattttcttcactaatgtcagactgtgggcctttgtatatacacttttaacaaactttttggaagtgcaatacatatcgcaacaacttctcaatgctgaatcatagtattggaagacattttaagcaacaattaaactcaacttatttactaccaataatgtacataagtcagctgaagtgaggataacatgaatagcacaaatacattatgattgctgcctggccaacagtaattataagaaactgtcagttttgagatgtgtcttgatttcagagatgttaaaaaagtttgtaagttaccattgataaaatatgagtttgcttccacaaatattctttcttctgtccttctggaactcaagagtaaacatatattagattttctcaccatttcatgcatgctggttcctaggctactctctgagtcattttttttttcttatctgccctccagttcactagttctgtcattttctgggtctgatctgctgcaaatgcaatacattgagttttaaatttcagtcattgtgttttcatttctagaaatttcatttgactctttctcaaattacttttccattttttttgtagtttcctatccctggagatattttcaatcatgccatttaattttttaaatacgcaagtgtagttttataatttgtgtctgataattctaatatctgaagtcttagtaggtctgtttcagttgtcctgtaattatgcatgtttttgcccatgttgctttgtttccttgtatgcttggttatctttcttactgcccttgcaaaattatttggagagtcctggaggcttaaatgaagataacttttaggaataatttgcatttgcttttgccgaggatcttgggatcatttcaaccaaaatcttagcttgaaattccgcaatcaatcaaggtgatgagaacctggtcagtaaatcctaatgagggccaggctgtggccaaagatttttagacagatgtttccctcctttgccatttctcttttctttcctcctctgctcctcttagtgtccagacaaccttcatggaagtccttggggtgggtgggaaatgaggacggcaggtttcattctaggtatagccctttgaggtctaacttaatgcagagagagttttctggtctatgtgccaccttacatgggatcttgagccttgatttctaaaccccttgcctttgatgtttcagaattgaagcttaaatttgccaacaggcaaatgtcctcaaggcaaattggcttaggtgttcgatattcttcttaccagaaaggtaaacttgggttttttacttcacccaggatttggcatgacagttccccattatttggtccgttaggggtaaggatgcgtttaacaattgcgttgtttcgg

SEQ ID NO: 289844 - DNA, 1570 bp, Homo sapiens
ctcaggcgggcgcggagccgcgcggagtgacaaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagaggtagggttggttttttaatactcgttctcactttaagtctcaccagggaggggtttgggaagcactgcgtgtttgggggacgttttgcgcttcctggtctctccagcctacaagtcgggagtcggcgaccgcttagtgacgagcgatgattttaaagagcagaataaaaggttttcccgtgcctgccccacagcccctccagctcgaataatggagaactgtcaatgcactccgcgagcggtggcccattgtacgcagctgatggcgaggaggcgactgggggtagcaggggctccttgccctcgtccctatgcccaaataaacgcgcaaacgcgctcccgtcttctggtcagttaaaaggtgaaacgaacacgattaaaatagaccaaaagaaaagaaagaaaagaaaacctttctatgtacagattctaaatcgtactccccatacagtcagaggcagggagtcgagggcagaggcagcaggcggagagagggagatagggcgagggaaggagaacgcggagagagacgaagggagtgggagaccagcgacagcgagcgccagggcaccgcaggcacactggatgcccagtccgccggcccagccgccctcggaccctggaccgtgcgtcgtgggcaccagaaacgagactcggccaaatcctgcctcaccagcaggtagatgaaactcaagagaaaaggtgtggataaatgaaactagcccatgatgaacctgttttctccgtgaccacaatattaaccaggatgaatggcggtggcagtgggcctgcatcacaggttgcagcagatgttctcaatatttctattaaaatttccttatttccatatgcaagaggagccccagagctgcatccttatggtagctaccatgccgtgatgtaagctgccattcactggggagctttggcaatagaattggctagatcaggaagcctatgtcaactatggaacaacaacttgcagctcatctctattgatgagtaaaagaatatggaattttagctccagatcaatttcaagaacaaatcaggaatcccgagaggacccacagaccctctgaaggaagcagactgctcctgtagaacccgggagacaccccaaatactgggagtgccccaactgcagaattgggaaagggagagcctcctgtactgaacacacagctccactggagaaactgaagattcagggtctcagtctgccaccctagctggagtgcagtggtgtgatcatcgctcactgaagcctggaactcctgggctcaaagtttcctcctgcatcagcctaagtagctgggactacaggtgtgcatcaccaccgtgccctggcctgaaaatatttattgaaaacaccttgtgtaca

SEQ ID NO: 289845 - DNA, 1988 bp, Homo sapiens
gcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctaatgatgatattgttcttgtacaagcactggaattagcagatgaagctagaagaaggagacagtttactgatgtcaaccgcttcaccctgagatgcatggtatgtcagaaaggattaactggacaagcagaagcaagggaacatgccaaggagacaggccataccaactttggagaagtgtgacctatgcatgaatgagggttgaagcctactacctcacacatccagaaggctctgggttttccaataagctatggtaaccctaaagaacaaaggatacaatgcttgaaccatccttttaacttaaaaccactaagacactgaaattccttgttaagattaaaattagtgtgcaagtttacagatgtgtgtctacagtggtaaactgtacatacatgcctctttctgctggagtgacagaataggtgatccttgccacctactgacactgacctgaaggttgagattgagtattataaactagcacccagcagctttaacttgtagaagaaagcatcacattttgggtaatgtggaaggcctcctgtgagtccactgggcatacgattgagattgagtattataaactagcacccagcagctttaacttgtagaagaaagcatcacattttgggtaatgtggaaggcctcctgtgagtccactggacatttaccacagtgtctccagtaactgagtctttttaaaaactctgaatgagttaagtttctaaattatgaattgattcatcaaatgaagatactcagaattgtccaaactgattttatattgcaatttggtagacattataaatgtgtgcttaaccactgataagtacatcacaagcaatttttacagggatgagtctcatccttgagaatgttatcacaaaacaggaactgattgtgccctgtttaagatctctagcatataaaacgtagaatgtatgagggaataggtgcctgagcagcttcctgaagctttaaaagaccgttggcctcgtgttttaatgcaattcatgtattggtctttgtcacattggataacattttaaagttaagcagggtacttttttaattgaaattccttgaaattcgagtcctcagttttttcttcatttgcgtaaagtttatcgggggggatttaattttctcagctttttgttaagagcacttcctccaaaaaatttttttcaagtaataatgctctgctttgggttggtttttgtaagattttttgcacacctaaagagtgtttgcttttgtgctagccttatccctccactaaagttattttaaataatttcacatttctgcaaattagcactttgcttatctgcaatcttttactttgatttttgaagttttaaagcaattggagtaatactgttgaatgaactagtttcacttccaaaatagaaaaaattg

SEQ ID NO: 289846 - DNA, 643 bp, Homo sapiens
gcaatggggataccattctggaagacttgcccatccaatctggtgacatgctgatcattgaagaagaccaaaccaggcccagaagttcacctgcatttactaaacgtggtgcttctagttacgtcagggaaactttgcctgtgcttaccagaaccgtggtcccagcagacaactcttgcctctttactagtgtgtactatgtcgtcgaaggaggagtcttgaatccagcttgtgcccctgagatgagacgcctcatagcacaaattgtagcaagcgatccagacttctatagtgaggcaatactgggaaaaacaaatcaagagtactgtgactggatcaaaagggatgacacttggggaggagcaatagagatatcgattttgtccaagttttaccaatgtgaaatatgtgtagtggatacacagacagtaagaattgatcgttttggggaagatgcaggatataccaaaagggttctgcttatttatgatggcatccactatgatccacttcagcgtaacttccctgatccagatacacctcctctgaccattttctcctctctgcgtttcaaacgcagagaggatgaacgctggacggatggtagcagtctagggattaacttcctgtatgctgcaactca

SEQ ID NO: 289847 - DNA, 2014 bp, Homo sapiens
ggccgggatgaaaagccacaggggggatggggagggccaagggccagggccgccaccaagtcgttcacagcagctgcttggtgtcctctctgcaggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaagggaatgatgtgattcaagctggaaagagggttgggagaaacagcttgtccaggtggagctatgttatgatcagatcgaagtgtgacccctgtgtggtccagacagccctgcagagagaaaacctttattccattatcaccaagcacctcctagtttccgacagtcatctccttctgctgggagaattagcagcagttcagggggcttatgttatgtccttgttcaactcaacttgagctcttgaactcctcctgtgggcctgtgaatgtattcattcattccacaactctgggtgcctcccacgtctggcaccgggggtacagtacacattccctgccttcatgccaggctgctgagcggggtggggagggaggcgctgctctcaggagggcaactgaacacctcactctctagaagatgcagcagtagatccaagagtccaggatgttccacacgtgctggaacggtgggtcagatgacacatgtgattcggggctaagaaaataagagtcactggggccagcagtcactgccaactgtccattctcacctctttcccgggcctggccccagaagagctaggagactttggtgctgggttaatattccttctctgagcctctatatctcatctgtaagataaaagagttgggatagatgaatggttgccaagcatttttgttggcaggactccttttaaaacatggtgctacatggcaccccgaattccagcattctcacagtaacacactgccccaattctcagtggcttacgacagcattgatttcttgtttgtgttaatgtggccacaggccagccacggctgagccctaggtgtgaaaagccaggctgaaggggtgtcccctgtcaggcatgaaagccagagagggaacagaaatccagcctccaagccccaccaagctcctggcctgatgtgtcagccccagctgctcacatcccatggctccaaacatgggaggcaccaggtcagcga

SEQ ID NO: 289848 - DNA, 523 bp, Homo sapiens
ggttttggggactctcctcaaggggcccgccctgtctctgcaggctgggtcattacatcagtggtgtttgctggagatagacagggaagaaatatttccttccccaggccctggtgccacaagtgcgccctagttctgtgaactttcttttaaaataccatttcttttattttcagatgtaactgggaatgtgacagcaacacgatgttttgatatgtatgaaggcggtaagaaaattttttctgttaaaattcaaatgaattttaaacagaaaattaagattaaaaagcacaaagaaaaatgtcaaccatttttattttgtctactagaaaaacgccagcagctctcctgagtaatctagagtggtcttatgtagatcctcttaaactctaattgaattcatagaacatttgaaggcatcatctagaaatgtcttttcttctgttagttttcctcagtctttctctttttagctctcatgatataataagaaagagaaaaagcctttttttttaaaaaaaaa

SEQ ID NO: 289849 - DNA, 1991 bp, Homo sapiens
cccgacacgaccgctgcccgccccttgccttcctgacccaggggctccgctggctgcggtcgcctgggagctgccgccagggccaggaggggagcggcacctggaagatgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaagggaatgatgtgattcaagctggaaagagggttgggagaaacagcttgtccaggtggagctatgttatgatcagatcgaagtgtgacccctgtgtggtccagacagccctgcagagagaaaacctttattccattatcaccaagcacctcctagtttccgacagtcatctccttctgctgggagaattagcagcagttcagggggcttatgttatgtccttgttcaactcaacttgagctcttgaactcctcctgtgggcctgtgaatgtattcattcattccacaactctgggtgcctcccacgtctggcaccgggggtacagtacacattccctgccttcatgccaggctgctgagcggggtggggagggaggcgctgctctcaggagggcaactgaacacctcactctctagaagatgcagcagtagatccaagagtccaggatgttccacacgtgctggaacggtgggtcagatgacacatgtgattcggggctaagaaaataagagtcactggggccagcagtcactgccaactgtccattctcacctctttcccgggcctggccccagaagagctaggagactttggtgctgggttaatattccttctctgagcctctatatctcatctgtaagataaaagagttgggatagatgaatggttgccaagcatttttgttggcaggactccttttaaaacatggtgctacatggcaccccgaattccagcattctcacagtaacacactgccccaattctcagtggcttacgacagcattgatttcttgtttgtgttaatgtggccacaggccagccacggctgagccctaggtgtgaaaagccaggctgaaggggtgtcccctgtcaggcatgaaagccagagagggaacagaaatccagcctccaagccccaccaagctcctggcctgatgtgtcagccccagctgctcacatcccatggctccaaacatgggaggcaccaggtcagcga

SEQ ID NO: 289850 - DNA, 1326 bp, Homo sapiens
ggccgggatgaaaagccacaggggggatggggagggccaagggccagggccgccaccaagtcgttcacagcagctgcttggtgtcctctctgcaggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtcaaaaaaaaaaatacaaaaaaacaaaattttggggcggccaggccccgaaaaattttcaaacccttcgtttgggcgcgggccccccggtagggaaccggccaggtcccaagggacaccgggccaggacgagggcgcgggatttcccaaaaaaaagccgggggaacgaggcttcgaaccacccagaagggtcgaagcccatcgggccaaacacggggtcagggaaccgaataaatgcgcgcgcagagaaaaaacaccacaacacacacaacatcacagagacgaacgaagactgatgacgcaaatgcaatctatcacaggcatcacacgacacgacagacacagcagacaaaggaactaacgaggacacagcgacgcagcactacacagcacgcagcaata

SEQ ID NO: 289851 - DNA, 505 bp, Homo sapiens
agtccaggtcccctgagggactgagtctgtagacactgagaatagatgtgtgtggatgaacatgggggtggcggtctcgggagctgcaccaaggcgaatgcagactttcaaggaaaaggtgggggacagcagatgagactgacatttggtcaggcgaagacttcgcggagcggggagagtcgcacgcctcttggtacttgactaatgcttagctccatttcagacttatgggagaacagctgggaaatgttgccagaggaataaacattgccattgtcaactgtaagttactaaacattttctttaaacttctctaaaagctctctggtcagattttcaaaggtaccttgggttttcgagacttttgcgcgtgatttagtctaggtttgtattttaatgcattttaagattatatactcaattatttttacaagtctcacttcacagattatttgtggttctaacaacaaataaacaactgaaaaccaaatatagactttatttt

SEQ ID NO: 289852 - DNA, 2045 bp, Homo sapiens
cccgacacgaccgctgcccgccccttgccttcctgacccaggggctccgctggctgcggtcgcctgggagctgccgccagggccaggaggggagcggcacctggaagatgcgcccattggctggtggcctgctcaaggtggtgttcgtggtcttcgcctccttgtgtgcctggtattcggggtacctgctcgcagagctcattccagatgcacccctgtccagtgctgcctatagcatccgcagcatcggggagaggcctgtcctcaaagctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaagggaatgatgtgattcaagctggaaagagggttgggagaaacagcttgtccaggtggagctatgttatgatcagatcgaagtgtgacccctgtgtggtccagacagccctgcagagagaaaacctttattccattatcaccaagcacctcctagtttccgacagtcatctccttctgctgggagaattagcagcagttcagggggcttatgttatgtccttgttcaactcaacttgagctcttgaactcctcctgtgggcctgtgaatgtattcattcattccacaactctgggtgcctcccacgtctggcaccgggggtacagtacacattccctgccttcatgccaggctgctgagcggggtggggagggaggcgctgctctcaggagggcaactgaacacctcactctctagaagatgcagcagtagatccaagagtccaggatgttccacacgtgctggaacggtgggtcagatgacacatgtgattcggggctaagaaaataagagtcactggggccagcagtcactgccaactgtccattctcacctctttcccgggcctggccccagaagagctaggagactttggtgctgggttaatattccttctctgagcctctatatctcatctgtaagataaaagagttgggatagatgaatggttgccaagcatttttgttggcaggactccttttaaaacatggtgctacatggcaccccgaattccagcattctcacagtaacacactgccccaattctcagtggcttacgacagcattgatttcttgtttgtgttaatgtggccacaggccagccacggctgagccctaggtgtgaaaagccaggctgaaggggtgtcccctgtcaggcatgaaagccagagagggaacagaaatccagcctccaagccccaccaagctcctggcctgatgtgtcagccccagctgctcacatcccatggctccaaacatgggaggcaccaggtcagcga

SEQ ID NO: 289853 - DNA, 1901 bp, Homo sapiens
cccgacacgaccgctgcccgccccttgccttcctgacccaggggctccgctggctgcggtcgcctgggagctgccgccagggccaggaggggagcggcacctggaagatgcgcccattggctggtgctccagtccccaaaaggcaaaaatgtgaccactggactccctgcccatctgacacctatgcctacaggttactcagcggaggtggcagaagcaagtacgccaaaatctgctttgaggataacctacttatgggagaacagctgggaaatgttgccagaggaataaacattgccattgtcaactatgtaactgggaatgtgacagcaacacgatgttttgatatgtatgaaggcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaagggaatgatgtgattcaagctggaaagagggttgggagaaacagcttgtccaggtggagctatgttatgatcagatcgaagtgtgacccctgtgtggtccagacagccctgcagagagaaaacctttattccattatcaccaagcacctcctagtttccgacagtcatctccttctgctgggagaattagcagcagttcagggggcttatgttatgtccttgttcaactcaacttgagctcttgaactcctcctgtgggcctgtgaatgtattcattcattccacaactctgggtgcctcccacgtctggcaccgggggtacagtacacattccctgccttcatgccaggctgctgagcggggtggggagggaggcgctgctctcaggagggcaactgaacacctcactctctagaagatgcagcagtagatccaagagtccaggatgttccacacgtgctggaacggtgggtcagatgacacatgtgattcggggctaagaaaataagagtcactggggccagcagtcactgccaactgtccattctcacctctttcccgggcctggccccagaagagctaggagactttggtgctgggttaatattccttctctgagcctctatatctcatctgtaagataaaagagttgggatagatgaatggttgccaagcatttttgttggcaggactccttttaaaacatggtgctacatggcaccccgaattccagcattctcacagtaacacactgccccaattctcagtggcttacgacagcattgatttcttgtttgtgttaatgtggccacaggccagccacggctgagccctaggtgtgaaaagccaggctgaaggggtgtcccctgtcaggcatgaaagccagagagggaacagaaatccagcctccaagccccaccaagctcctggcctgatgtgtcagccccagctgctcacatcccatggctccaaacatgggaggcaccaggtcagcga

SEQ ID NO: 289854 - DNA, 1678 bp, Homo sapiens
aatgagactttcaaaaacaagtttttataaagatagtgaagacgaagaatagaaaacgcctgcacccacccaataagaaggacacagttgtactctgcagttaacctaagcagaacagtaaataatgagccgcagcgataactctggaccgatgacaaagtttattcagagtgctgctccaaaatccctgctcttcatggtgacctatgacgacggaagcacaagactgaataacgatgccaagaatgccatagaagcacttggaagtaaagaaatcaggaacatgaaattcaggtctagctgggtatttattgcagcaaaaggcttggaactcccttccgaaattcagagagaaaagatcaaccactctgatgctaagaacaacagatattctggctggcctgcagagatccagatagaaggctgcatacccaaagaacgaagctgacactgcagggtcctgagtaaatgtgttctgtataaacaaatgcagctggaatcgctcaagaatcttatttttctaaatccaacagcccatatttgatgagtattttgggtttgttgtaaaccaatgaacatttgctagttgtatcaaatcttggtacgcagtatttttataccagtattttatgtagtgaagatgtcaattagcaggaaactaaaatgaatggaaattcttaaagggaatgatgtgattcaagctggaaagagggttgggagaaacagcttgtccaggtggagctatgttatgatcagatcgaagtgtgacccctgtgtggtccagacagccctgcagagagaaaacctttattccattatcaccaagcacctcctagtttccgacagtcatctccttctgctgggagaattagcagcagttcagggggcttatgttatgtccttgttcaactcaacttgagctcttgaactcctcctgtgggcctgtgaatgtattcattcattccacaactctgggtgcctcccacgtctggcaccgggggtacagtacacattccctgccttcatgccaggctgctgagcggggtggggagggaggcgctgctctcaggagggcaactgaacacctcactctctagaagatgcagcagtagatccaagagtccaggatgttccacacgtgctggaacggtgggtcagatgacacatgtgattcggggctaagaaaataagagtcactggggccagcagtcactgccaactgtccattctcacctctttcccgggcctggccccagaagagctaggagactttggtgctgggttaatattccttctctgagcctctatatctcatctgtaagataaaagagttgggatagatgaatggttgccaagcatttttgttggcaggactccttttaaaacatggtgctacatggcaccccgaattccagcattctcacagtaacacactgccccaattctcagtggcttacgacagcattgatttcttgtttgtgttaatgtggccacaggccagccacggctgagccctaggtgtgaaaagccaggctgaaggggtgtcccctgtcaggcatgaaagccagagagggaacagaaatccagcctccaagccccaccaagctcctggcctgatgtgtcagccccagctgctcacatcccatggctccaaacatgggaggcaccaggtcagcga

SEQ ID NO: 289855 - DNA, 2371 bp, Homo sapiens
atatagagcaggcgccgcgggtcgcagcacagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgat

SEQ ID NO: 289856 - DNA, 2394 bp, Homo sapiens
atatagagcaggcgccgcgggtcgcagcacagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgataaaaaaaaaacaacaacaaaaaa

SEQ ID NO: 289857 - DNA, 955 bp, Homo sapiens
ggtcatagctgactctagaggataaacggtccccagggaggaaacgggcaccacccgctttcttgctggttgtcatttttgcagtagagtcatctccatcagctgtaagaagagactgggaagataggctctgcacagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgat

SEQ ID NO: 289858 - DNA, 911 bp, Homo sapiens
aataacagggcataatggtgcatacctgtggtcccagctactagggaggctgaggtaggaggactgcttgagccaaggggtttaaggctgcaagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgat

SEQ ID NO: 289859 - DNA, 759 bp, Homo sapiens
tgagagagaggtttattgtctattttgttcattgctgaagctctaacccctatatcaatgtctggcacgtagcagggacactggtccctgccgagtgggtcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgat

SEQ ID NO: 289860 - DNA, 573 bp, Homo sapiens
gccactgtccttcagcaaacgtaccatgcccacagatctgatgctcttcagctgggcctggggaaacataattactgcaggtgaggtgggggcaacaaggaccaaaagccctccctacagcttcccagaaaccttgttaccatccccttctcccagagggctggccatagcacaagagaagtgcggcctctggttgagtcttccctgaggggaggaggcagggaaggccctctgggttggaatgacatcccctatctttctgtgttgccaggaacccagacaaccggaggcgaccctggtgctatgtgcaggtgggcctaaagccgcttgtccaagagtgcatggtgcatgactgcgcagatggtgagcatcactgacctgctgatgacagtggggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaag

SEQ ID NO: 289861 - DNA, 460 bp, Homo sapiens
gaccggccctctgggcagaggcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggtgagtgttccaagcatctctctccacctcttccatatctccccagagctcctgggcttgttccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaac

SEQ ID NO: 289862 - DNA, 2392 bp, Homo sapiens
atatagagcaggcgccgcgggtcgcagcacagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgatgaaaaagaaggaagaaaaaag

SEQ ID NO: 289863 - DNA, 2343 bp, Homo sapiens
atatagagcaggcgccgcgggtcgcagcacagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaacgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgat

SEQ ID NO: 289864 - DNA, 1855 bp, Homo sapiens
gatatgctcgtacccgtcagacgctgaactatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggtgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgat

SEQ ID NO: 289865 - DNA, 1294 bp, Homo sapiens
tgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactgaaaaaaaaagcc

SEQ ID NO: 289866 - DNA, 497 bp, Homo sapiens
gtgagtgggggcagcggggtgtcccagaggcccttccgtgaccgagtgctgcacctcctggcactacggccctaccgcaaggctgagctgcctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactgaaaaaaaaagcc

SEQ ID NO: 289867 - DNA, 1245 bp, Homo sapiens
  misc_feature (1230)..(1230): n is a, c, g, or t
tgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctccaagttacctccaagangtgtccaacttataa

SEQ ID NO: 289868 - DNA, 1234 bp, Homo sapiens
  misc_feature (1218)..(1218): n is a, c, g, or t
tgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccactcaacgaccaaatgtaaacaaaataaacggcatactctgcctcatacagtatcccgatatattctaacaagatcacgnttacctccaggcacta

SEQ ID NO: 289869 - DNA, 1052 bp, Homo sapiens
tgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaactt

SEQ ID NO: 289870 - DNA, 1020 bp, Homo sapiens
gaagcggctgcagcctcctgatttcatcgaccccctagccaacaagaaaccccggatatcgcaaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactgaaaaaaaaagcc

SEQ ID NO: 289871 - DNA, 507 bp, Homo sapiens
aagaagagatcaggaaaaaaaacccaccagtcaaggaaagtcaagtagcaagaaggaaatgtctaaaagagatggcaaggagaaaaaagacagaggagtgacgaggtttcaggaaaatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaag

SEQ ID NO: 289872 - DNA, 1816 bp, Homo sapiens
cattcatttcaaaaataagctttgaatttagatggtaaggcatatatgttttatttcacatgacttcagggtagaagtcaaatgaagaaacatttctatggaaacttaccctttaagaaaccagtatatgcaaagaatgattgataccccctgagggtgtgccatataataggtgactgataacatacaggatttaattcttagaataattaagaacagatatcacccattacattgacctacatttttctaaagtgaacaatagaaacctctctcagaattagtatttgcctattaatgtaatcagtgtagccttctcaacataaaaatgtccttattctagaacatggaagcgtacggcaaatgcaacggttgaaagcactgaaaaatatttgtaaaacatctgtagtgctcacattatgaactttaaatgtaatactttgaaaaccatcttcataatttttttgttctaacagcttcctttttaagaaaacattttaaaacattttaaaatggaacttaatgtgcaaaataagttgtgtaaaataccagtatttgggtggtggaggatattggtatattatattgacctgggttgatgactactggactattttaagatacctacttccaaaacttattttattctagaggaccactaaaaatcagaattacagcaatcattttaatttttctactttccttgttaaggtcttctgcttacccaaagaatagtgtatatcttaacatgacttttaaaggggtatcttgatccccatcacagatttttatctatgaatagaaggattgaaaccctatttgatccctagctctttgctgaaaagtgcataaacaggaatcctgaatttattatatagacctcctcgcattatataatcgaagcaaagggaaaccagcgatggagtagaggtacgtagactaaagagatgcttgcaaatgatggtacctagggatagtcacattttcttgttgccaaactcagacaatataatcacaagtccagagaagagctagttaattttaaattccccgaggtccttttactgagatggaaaagcacaaacagtcaaggaaaaccaaagagggaggggtgagggaaggggaaagtgcataaagcacttaaagattttttaaaagtaggtatgatagataagccacaagaagtttttaagactactaataaccataattctattttaatcagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgtcctccagttctgcatccttggattcaaccaactgtgggttgaaaatactggaggtaaaaagacaaaaaataacaatgaagaacaacaacaaaaatacacagtataataattacatttacatagcatttattttgtattagacattataagtaatctagagatgatttaaagtatatgggagaatgtatgtagattatatggaaatatgagggtattttatttaaagggacttgggcctgtggataccaaggaataactaaggtaaaactgagcataagtggcctgtccatattttgttaaatatcagatt

SEQ ID NO: 289873 - DNA, 1385 bp, Homo sapiens
cattcatttcaaaaataagctttgaatttagatggtaaggcatatatgttttatttcacatgacttcagggtagaagtcaaatgaagaaacatttctatggaaacttaccctttaagaaaccagtatatgcaaagaatgattgataccccctgagggtgtgccatataataggtgactgataacatacaggatttaattcttagaataattaagaacagatatcacccattacattgacctacatttttctaaagtgaacaatagaaacctctctcagaattagtatttgcctattaatgtaatcagtgtagccttctcaacataaaaatgtccttattctagaacatggaagcgtacggcaaatgcaacggttgaaagcactgaaaaatatttgtaaaacatctgtagtgctcacattatgaactttaaatgtaatactttgaaaaccatcttcataatttttttgttctaacagcttcctttttaagaaaacattttaaaacattttaaaatggaacttaatgtgcaaaataagttgtgtaaaataccagtatttgggtggtggaggatattggtatattatattgacctgggttgatgactactggactattttaagatacctacttccaaaacttattttattctagaggaccactaaaaatcagaattacagcaatcattttaatttttctactttccttgttaaggtcttctgcttacccaaagaatagtgtatatcttaacatgacttttaaaggggtatcttgatccccatcacagatttttatctatgaatagaaggattgaaaccctatttgatccctagctctttgctgaaaagtgcataaacaggaatcctgaatttattatatagacctcctcgcattatataatcgaagcaaagggaaaccagcgatggagtagaggtacgtagactaaagagatgcttgcaaatgatggtacctagggatagtcacattttcttgttgccaaactcagacaatataatcacaagtccagagaagagctagttaattttaaattccccgaggtccttttactgagatggaaaagcacaaacagtcaaggaaaaccaaagagggaggggtgagggaaggggaaagtgcataaagcacttaaagattttttaaaagtaggtatgatagataagccacaagaagtttttaagactactaataaccataattctattttaatcagctatttagctggtacctactgctatatcacctagtgtgacatttcggaattaatggaacaatgaaggaagctgtacactggaggttccaggtggtcatggaaggtaggttactcttaaagtttgaaattgtaaagtgtgaaagtctggatagaggggaag

SEQ ID NO: 289874 - DNA, 303 bp, Homo sapiens
  misc_feature (295)..(295): n is a, c, g, or t
tcagcgccctgatgatgagttttctgacttcgtcatatacgaagatgacaagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtggaaccgagctggtttagcgtacgcaatcaatnttccccca

SEQ ID NO: 289875 - DNA, 3633 bp, Homo sapiens
attggaagcgcactgcgcggcctccaccgcgctctcggcccgggttcggcgtgggggcggggaggtaagtacggtaatgggcggggccgagcgcgggcgcgctccggctttcctcctgcgcagtgctcccgtcagcgcagggggcggggcgcctatattacgtgcgcggcgccgctcctgcgagaggacgttgcgtgctcgctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaat

SEQ ID NO: 289876 - DNA, 684 bp, Homo sapiens
cctttttgtcccagttgtcattattttcgaattcctaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgtgaagcctgtgaaagtttcagctccccgagttggtggaaaacgctaaactggcagattagatttttaaataaag

SEQ ID NO: 289877 - DNA, 3441 bp, Homo sapiens
tacattccccaactatcggctaggtacgaggctgggtgttacgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaat

SEQ ID NO: 289878 - DNA, 4330 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289879 - DNA, 4174 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaaaaaaaaaaacacccgcggaacaaaacaacaaaaaacaagcaaaatcacaacaacacaaaaaaacaaaacaaacaaaacaacaaaacaccccacggcgaacaaccaaacaccaatcaaaacacaaacaaacacactcatttgcgcccgcgcgcccccccgccataaagaaaggagatgtttatcatacaaaaacaaccaccggtcgtgggcgggggcgcgcccaccccaatacagagatgtagacaaaccagagcaggggcggaagcaaagcttgacctcgatcaaaggaagaacaccaacccgtccaggaccagtagtgacgtgggaggatactccccagcaaaaaaaaaaaacgacgcgcgcgcgggggaaacagccacagtgggtctggtagcaccaaccaacccagaggaggtgcgtctcggagagacactcgtaggacgcaccataccgag

SEQ ID NO: 289880 - DNA, 4359 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggaaggtggggaggggggaaaaaaccccaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289881 - DNA, 3728 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttattgcaaacaaacgtctaaattaatttctccacccactttctttagaaagaaaaaggtcgacgc

SEQ ID NO: 289882 - DNA, 4223 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289883 - DNA, 4480 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289884 - DNA, 3514 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatgaaacaacaacacaaaacaaaaaaggggggggcggcataaaaaattatcacg

SEQ ID NO: 289885 - DNA, 6549 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcaggtataggatgctcacctagttttactcatcccttattcgttcgttgatcggaaagctgtatcaggagacaattctgtctttcagagccaaatctcctcagccacctgttgaagaagaagatgaacacttcgatgacacagtggtttgtcttgatacttgtaagtgaagctgtttctccccaattatgaaatgcggtgatggtggtttttttttttttttttttagaagtcttaatgcttaagtgcagcaaaacttgggttagtttttttaaaagcaggaagataatggtttacattcagaacctagtagtttaatatttagcacgtcatcagttgtattaagtggattattttacaggctctaggagtttcgtatttttatgacttgaaagttctcattcttaggaaatgtaaaattaatgccagtttttgactagctaacggaaacttgtaacactacctataatttagccttacaggcttctacaataaagtaattcatttttttgtggaattatattaagtgagctatttgggctagttaaatatttactaatgacttctcccattagcacacaagtatattccctattttaaaagattgtaatattactttttcaataactgctcttttgttctcaattccagttcagtagctgctgctttaaacataagttgatttcttccaaagacctgaggcagcagcagtgggctatcactgggccactagctttcttcagcagcgaatggtatcaatggcagtgcagcactgtaaatactgctactttacccagttgggttgcaattgagtgagaaagtattgcaaacctctaagtgggctttgactgtcagacttgtttttttttttttttttttgttacaaaaaaacgtagttggtttagtgatgagaatgtacaactctgggtgtgataaatagaccaaaggataaaaataactgtttcaaaagtatcagctatggtgtcagcctgctgtgttagatggaaggcattggagcttagcttctcatgttttcttgtacaaattggctttattcagatttgtaagagtgtcaatgtaaaactctttcttactggaatatcctttacagaaggttgagatagtcatctgagcctttttaaaagaaaaaactgcaggtgaaaaaggagttagttgatgtgaaagttttagtgaaattctgggttgtataaataagttgctaggaattggcaaggtagtgaagtggtgactcacacaggtaatgtaattgttagattttttagcaaatcaggaatatgtcaatataagtacaatgttgaattcaaacaatctgttgaattaaattctgttgattagaataactctaatttaagaaaaattccaaactgtagatttatttttctctgatcagtaaaaagaaaatgagttccagcttgactttagctgttcaagtgagaagtctgaggaagtgcatgttaatgagccagtgacccataggtagctgggttaaagacactttggatttggataatccgggaagcaattaatccctaattgttgaacaggcagtcctgggtaaagaggacctaaaatgctgcactattaacagcattagacggccaggtttgtacttcatagttttaggctgtcttcttcacaagttttagaaaaagaatttaggagctagagccctggtgcaggatcaacagcagctcatactcctattttaaaataatttggtcgtggcctcccttcagttttaatgtggcactggtaaatctacctggttctggcatgcttcactttgatttcctgctatcctctactgcttgcctctaaatcaaggtaaagagcagagcaggtatgtattaatgtcacattgtcttgattattttaaatacttaaaatatacatgttaaaccttggtattagtttcacaggcagtttacttttcagtacataatttaacaggagtgacttggtgggagtggggctttaaactgaaaattggaacaacagcatgatgtggagaaaagttgtgcagcattaagaagtacatgcaaaaattaagtaaccaagttttgtctacatagcagatatgtttacattggatgtcaaaagtaacacagtatttgatataattacagataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289886 - DNA, 5829 bp, Homo sapiens
agcggagtacaatgcggccgcggggagcgcgggcccgcgggggaggggagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcaggtataggatgctcacctagttttactcatcccttattcgttcgttgatcggaaagctgtatcaggagacaattctgtctttcagagccaaatctcctcagccacctgttgaagaagaagatgaacacttcgatgacacagtggtttgtcttgatacttgtaagtgaagctgtttctccccaattatgaaatgcggtgatggtggtttttttttttttttttttagaagtcttaatgcttaagtgcagcaaaacttgggttagtttttttaaaagcaggaagataatggtttacattcagaacctagtagtttaatatttagcacgtcatcagttgtattaagtggattattttacaggctctaggagtttcgtatttttatgacttgaaagttctcattcttaggaaatgtaaaattaatgccagtttttgactagctaacggaaacttgtaacactacctataatttagccttacaggcttctacaataaagtaattcatttttttgtggaattatattaagtgagctatttgggctagttaaatatttactaatgacttctcccattagcacacaagtatattccctattttaaaagattgtaatattactttttcaataactgctcttttgttctcaattccagttcagtagctgctgctttaaacataagttgatttcttccaaagacctgaggcagcagcagtgggctatcactgggccactagctttcttcagcagcgaatggtatcaatggcagtgcagcactgtaaatactgctactttacccagttgggttgcaattgagtgagaaagtattgcaaacctctaagtgggctttgactgtcagacttgtttttttttttttttttttgttacaaaaaaacgtagttggtttagtgatgagaatgtacaactctgggtgtgataaatagaccaaaggataaaaataactgtttcaaaagtatcagctatggtgtcagcctgctgtgttagatggaaggcattggagcttagcttctcatgttttcttgtacaaattggctttattcagatttgtaagagtgtcaatgtaaaactctttcttactggaatatcctttacagaaggttgagatagtcatctgagcctttttaaaagaaaaaactgcaggtgaaaaaggagttagttgatgtgaaagttttagtgaaattctgggttgtataaataagttgctaggaattggcaaggtagtgaagtggtgactcacacaggtaatgtaattgttagattttttagcaaatcaggaatatgtcaatataagtacaatgttgaattcaaacaatctgttgaattaaattctgttgattagaataactctaatttaagaaaaattccaaactgtagatttatttttctctgatcagtaaaaagaaaatgagttccagcttgactttagctgttcaagtgagaagtctgaggaagtgcatgttaatgagccagtgacccataggtagctgggttaaagacactttggatttggataatccgggaagcaattaatccctaattgttgaacaggcagtcctgggtaaagaggacctaaaatgctgcactattaacagcattagacggccaggtttgtacttcatagttttaggctgtcttcttcacaagttttagaaaaagaatttaggagctagagccctggtgcaggatcaacagcagctcatactcctattttaaaataatttggtcgtggcctcccttcagttttaatgtggcactggtaaatctacctggttctggcatgcttcactttgatttcctgctatcctctactgcttgcctctaaatcaaggtaaagagcagagcaggtatgtattaatgtcacattgtcttgattattttaaatacttaaaatatacatgttaaaccttggtattagtttcacaggcagtttacttttcagtacataatttaacaggagtgacttggtgggagtggggctttaaactgaaaattggaacaacagcatgatgtggagaaaagttgtgcagcattaagaagtacatgcaaaaattaagtaaccaagttttgtctacatagcagatatgtttacattggatgtcaaaagtaacacagtatttgatataattacagataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289887 - DNA, 3451 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaaggcggccgctgggatcctctagatcacctca

SEQ ID NO: 289888 - DNA, 3228 bp, Homo sapiens
tcctcaaaatgaaaggaaactttaccctcccaggggtagctgagtgctttgatgaaataacctatgttgaacttcagaaggaagaagcccaaaaactcttggagcaatataaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289889 - DNA, 2986 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgta

SEQ ID NO: 289890 - DNA, 2617 bp, Homo sapiens
ttccggttttggggcctttgctttgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289891 - DNA, 3194 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtaaaaaaaaaaaaaaaaaaaaaaaggggggggggtaaaaagttcctaggggcgaggtttcggtaccagtttgtgtaaggggccatgggggcggatatagaggcaggcgcgttaaggtggtggaatgctctggacttgggcctctgggggggctttggccctacgggtagctagaataattcgtttgtacacgtttggtgagtgccgtata

SEQ ID NO: 289892 - DNA, 2996 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttacaaagcaacattttacttctgttgtgataaaagtcgacg

SEQ ID NO: 289893 - DNA, 2373 bp, Homo sapiens
caactacggactagtacgaggccggtgttaatcgacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289894 - DNA, 2891 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagtgtctccggtaccggcctgattat

SEQ ID NO: 289895 - DNA, 2098 bp, Homo sapiens
atcgagctcggtccggagacacttacgtggaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289896 - DNA, 2721 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaag

SEQ ID NO: 289897 - DNA, 3461 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagcttttctgtccatgtgaatgtgctgtgtggaagagttaaagggcccaactaaatgttccagtgattccaatagctatttagctggtacctactgctatatcacctagtgtgacatttcggaattaatggaacaatgaaggaagctgtacactggaggttccaggtggtcatggaaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgtcctccagttctgcatccttggattcaaccaactgtgggttgaaaatactggaggtaaaaagacaaaaaataacaatgaagaacaacaacaaaaatacacagtataataattacatttacatagcatttattttgtattagacattataagtaatctagagatgatttaaagtatatgggagaatgtatgtagattatatggaaatatgagggtattttatttaaagggacttgggcctgtggataccaaggaataactaaggtaaaactgagcataagtggcctgtccatattttgttaaatatcagatt

SEQ ID NO: 289898 - DNA, 3455 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtgtaagtaatttcttatgtgctttatgtacattaattgtattttgagttcctaagatttatcagtcttgaaaaagatcttgtacagggattgaagtgtttataagtgttaatagggtaaagtgtgaatcgtcttgcagtagtagccataatctaccttttgaaggcaaaataggttgaagattgctataagttaaatttttttaataaagtaatattatttaatatatacagttcttttactgctagctttaattgtgtaaactaacaaagtcatgatgtttcgttttgtaatgtgtattgataattatgggatattaaaactaaatctggtttggtagaaatcagaggtatgacaggtataaatttgtttccagcaaattactctgaattagattcattgtcatttcctaaaaacagtttgagtggcttattgatgttttttctttaaaaacaaaattttctcttacagcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgta

SEQ ID NO: 289899 - DNA, 2659 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcagttctgaggttttgagttctgatacgttttgaggtgatcctt

SEQ ID NO: 289900 - DNA, 2645 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattccccagggggccggtaccgagctcc

SEQ ID NO: 289901 - DNA, 2059 bp, Homo sapiens
aagaagagatcaggaaaaaaaacccaccagtcaaggaaagtcaagtagcaagaaggaaatgtctaaaagagatggcaaggagaaaaaagacagaggagtgacgaggtttcaggaaaatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289902 - DNA, 2523 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacaggcttggtggggaattactagtgaattcgc

SEQ ID NO: 289903 - DNA, 2368 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaatacaccacatgttctcactcataagggggagttgaacattgagaacacattgacacagggagtgggaacaccacacaccagggcctgtcggtgggtgggtgttga

SEQ ID NO: 289904 - DNA, 2231 bp, Homo sapiens
ttgtatatcgaggtgatctaaggatcccagggaacttcagaggacgaggaaacaatcgtggctacaaaaatcaatctcagggctacaaccagtggcagcagggtgtaagtaatttcttatgtgctttatgtacattaattgtattttgagttcctaagatttatcagtcttgaaaaagatcttgtacagggattgaagtgtttataagtgttaatagggtaaagtgtgaatcgtcttgcagtagtagccataatctaccttttgaaggcaaaataggttgaagattgctataagttaaatttttttaataaagtaatattatttaatatatacagttcttttactgctagctttaattgtgtaaactaacaaagtcatgatgtttcgttttgtaatgtgtattgataattatgggatattaaaactaaatctggtttggtagaaatcagaggtatgacaggtataaatttgtttccagcaaattactctgaattagattcattgtcatttcctaaaaacagtttgagtggcttattgatgttttttctttaaaaacaaaattttctcttacagcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289905 - DNA, 2277 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggcatggaattttaattctgttactgtgtgaaatcttctttttaaaagaatgtttttcctacatattctgcttgtgtaactatgttaaatctattaggacttaggcctcctgaaagttaacattttttccagcaatactgcttcaggaattaaaattgcagttgttacatatgca

SEQ ID NO: 289906 - DNA, 2150 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaactgtaccctcccagaggtagctgttgtaactggggccggctcag

SEQ ID NO: 289907 - DNA, 1575 bp, Homo sapiens
gtactactactaattgcggccgctcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289908 - DNA, 2253 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagaactgcaaattgttacaattactttgaagagcaattttggaataactaaaaaaaaaatgttaatatgagtaatctaccaagcagaaatttggcttctagatgtttaccagagagtaaatgcacaaggatgtatattcaagactattcattgcaacatttttcataatagcaaaataactggaaaaagaccccataaatgttataagattatatactttttaaaaaggagagaaatcctatgtatatctttttatggttgcatacatgcttagagaaagtatataatgatacacagcaatatccatatagcaatgggatacggcaaagggctccagggccagatgcctgtgttggaatcctgcacaccagctgtgtgccttggatagctgct

SEQ ID NO: 289909 - DNA, 1856 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagtagaagaaaaactggtgggaacaaagacagcag

SEQ ID NO: 289910 - DNA, 2113 bp, Homo sapiens
  misc_feature (56)..(57): n is a, c, g, or t
  misc_feature (1955)..(1955): n is a, c, g, or t
  misc_feature (2067)..(2067): n is a, c, g, or t
  misc_feature (2076)..(2076): n is a, c, g, or t
  misc_feature (2109)..(2109): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaggggggatagagagaaagaggtaaaaccccaaacccaaacaaggggccaggcgctgtggctcacacctgtaatctcagcactttggaagtctgagacgggagaatcacttgagctcaggagtttgagaccagcctgggcaacaaagtgagaccccataccccaaatacaaaaagttagccaggcatagtttcatgggccttgtantcccggccacttaggtggctgaggtgggaggatcacttgagccctgggctgtctaggctgcagtcagctgtgatggcaccactgtactgcaacctgggtgacagagcaagancctgtttcnaaaacaacaacaacaataacaacaagcattgantgat

SEQ ID NO: 289911 - DNA, 2741 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttgtaagtgaagctgtttctccccaattatgaaatgcggtgatggtggtttttttttttttttttttagaagtcttaatgcttaagtgcagcaaaacttgggttagtttttttaaaagcaggaagataatggtttacattcagaacctagtagtttaatatttagcacgtcatcagttgtattaagtggattattttacaggctctaggagtttcgtatttttatgacttgaaagttctcattcttaggaaatgtaaaattaatgccagtttttgactagctaacggaaacttgtaacactacctataatttagccttacaggcttctacaataaagtaattcatttttttgtggaattatattaagtgagctatttgggctagttaaatatttactaatgacttctcccattagcacacaagtatattccctattttaaaagattgtaatattactttttcaataactgctcttttgttctcaattccagttcagtagctgctgctttaaacataagttgatttcttccaaagacctgaggcagcagcagtgggctatcactgggccactagctttcttcagcagcgaatggtatcaatggcagtgcagcactgtaaatactgctactttacccagttgggttgcaattgagtgagaaagtattgcaaacctctaagtgggctttgactgtcagacttgtttttttttttttttttttgttacaaaaaaacgtagttggtttagtgatgagaatgtacaactctgggtgtgataaatagaccaaaggataaaaataactgtttcaaaagtatcagctatggtgtcagcctgctgtgttagatggaaggcattggagcttagcttctcatgttttcttgtacaaattggctttattcagatttgtaagagtgtcaatgtaaaactctttcttactggaatatcctttacagaaggttgagatagtcatctgagcctttttaaaagaaaaaactgcaggtgaaaaaggagttagttgatgtgaaagttttagtgaaattctgggttgtataaataagttgctaggaattggcaaggtagtgaagtggtgactcacacaggtaatgtaattgttagattttttagcaaatcaggaatatgtcaatataagtacaatgttgaattcaaacaatctgttgaattaaattctgttgattagaataactctaatttaagaaaaattccaaactgtagatttatttttctctgatcagtaaaaagaaaatgagttccagcttgactttagctgttcaagtgagaagtctgaggaagtgcatgttaatgagccagtgacccataggtagctgggttaaagacactttggatttggataatccgggaagcaattaatccctaattgttgaacaggcagtcctgggtaaagaggacctaaaatgctgcactattaacagcattagacggccaggtttgtacttcatagttttaggctgtcttcttcacaagttttagaaaaagaatttaggagctagagccctggtgcaggatcaacagcagctcatactcctattttaaaataatttggtcgtggcctcccttcatcgctcctgttaaattatgtactgaaaagtaaactgcctgtgaaactaataccaaggtataacatgtatattttaagta

SEQ ID NO: 289912 - DNA, 552 bp, Homo sapiens
aaaacttagatatttaaattggccttaacaatatttaaagaattattaggtggtgtctactgacagtgaaatgacatttcttttcttttcactaggttgtgatgatgattggcttgccaggagctggaaaaactacctgggttactaaacatgcagcagaaaatccagggaaatataacattcttggcacaaatactattatggataagatgatggtaagtaaaatgtttagggcctgatctcagtgtttaaaatagactgggagaggctgggcatggtggttcacgcctgtaatctcagcattttgagaggctgaggtggatggatcacctgaggtcaggagtttgagacccacctggccaacatggcgaagccccgttcctactaaaaatttaaaaattagctgggtgtggtagtgggttcctgtaatcccagctgctcgggaggttgaggcagggacaattacttgaacctgggaggcagaggttgcagtgagttgagatcgtgccattgtactccagtctgggcgacagagcaacactccgtctcaga

SEQ ID NO: 289913 - DNA, 512 bp, Homo sapiens
gagatcgagctcggtaccggagacacttacgtagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgatctaagagaggaggtgaaggtcagacctgggtcgcacctatcacagaccacctggaacctgctctaataatctcctggccacaaaaacccaggccccctttgttaccccttctaccagtgctacg

SEQ ID NO: 289914 - DNA, 629 bp, Homo sapiens
gtgttacagactttggtaatttattaatacacttgtaaaatcttaatagcataagaataaaaattattagtgatcatgtaaatacatgaaacatttaaaaaataatccaaccaaatatgttacaactttgtttttatccaggtttccagtttatgcaaacttctgtgaaaatgagctttgttattggtgaagacattggaaattttaccagccaaaacagagtttctctcttattcagggtaagatgtaattgcagtgtgctagcgctggaagggacctgttttatatgttatgtatgttacacgtcagccctccatgtcctccagttctgcatccttggattcaaccaactgtgggttgaaaatactggaggtaaaaagacaaaaaataacaatgaagaacaacaacaaaaatacacagtataataattacatttacatagcatttattttgtattagacattataagtaatctagagatgatttaaagtatatgggagaatgtatgtagattatatggaaatatgagggtattttatttaaagggacttgggcctgtggataccaaggaataactaaggtaaaactgagcataagtggcctgtccatattttgttaaatatcagatt

SEQ ID NO: 289915 - DNA, 3690 bp, Homo sapiens
attggaagcgcactgcgcggcctccaccgcgctctcggcccgggttcggcgtgggggcggggaggtaagtacggtaatgggcggggccgagcgcgggcgcgctccggctttcctcctgcgcagtgctcccgtcagcgcagggggcggggcgcctatattacgtgcgcggcgccgctcctgcgagaggacgttgcgtgctcgctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaat

SEQ ID NO: 289916 - DNA, 3462 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaat

SEQ ID NO: 289917 - DNA, 4273 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289918 - DNA, 6258 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttgtaagtgaagctgtttctccccaattatgaaatgcggtgatggtggtttttttttttttttttttagaagtcttaatgcttaagtgcagcaaaacttgggttagtttttttaaaagcaggaagataatggtttacattcagaacctagtagtttaatatttagcacgtcatcagttgtattaagtggattattttacaggctctaggagtttcgtatttttatgacttgaaagttctcattcttaggaaatgtaaaattaatgccagtttttgactagctaacggaaacttgtaacactacctataatttagccttacaggcttctacaataaagtaattcatttttttgtggaattatattaagtgagctatttgggctagttaaatatttactaatgacttctcccattagcacacaagtatattccctattttaaaagattgtaatattactttttcaataactgctcttttgttctcaattccagttcagtagctgctgctttaaacataagttgatttcttccaaagacctgaggcagcagcagtgggctatcactgggccactagctttcttcagcagcgaatggtatcaatggcagtgcagcactgtaaatactgctactttacccagttgggttgcaattgagtgagaaagtattgcaaacctctaagtgggctttgactgtcagacttgtttttttttttttttttttgttacaaaaaaacgtagttggtttagtgatgagaatgtacaactctgggtgtgataaatagaccaaaggataaaaataactgtttcaaaagtatcagctatggtgtcagcctgctgtgttagatggaaggcattggagcttagcttctcatgttttcttgtacaaattggctttattcagatttgtaagagtgtcaatgtaaaactctttcttactggaatatcctttacagaaggttgagatagtcatctgagcctttttaaaagaaaaaactgcaggtgaaaaaggagttagttgatgtgaaagttttagtgaaattctgggttgtataaataagttgctaggaattggcaaggtagtgaagtggtgactcacacaggtaatgtaattgttagattttttagcaaatcaggaatatgtcaatataagtacaatgttgaattcaaacaatctgttgaattaaattctgttgattagaataactctaatttaagaaaaattccaaactgtagatttatttttctctgatcagtaaaaagaaaatgagttccagcttgactttagctgttcaagtgagaagtctgaggaagtgcatgttaatgagccagtgacccataggtagctgggttaaagacactttggatttggataatccgggaagcaattaatccctaattgttgaacaggcagtcctgggtaaagaggacctaaaatgctgcactattaacagcattagacggccaggtttgtacttcatagttttaggctgtcttcttcacaagttttagaaaaagaatttaggagctagagccctggtgcaggatcaacagcagctcatactcctattttaaaataatttggtcgtggcctcccttcagttttaatgtggcactggtaaatctacctggttctggcatgcttcactttgatttcctgctatcctctactgcttgcctctaaatcaaggtaaagagcagagcaggtatgtattaatgtcacattgtcttgattattttaaatacttaaaatatacatgttaaaccttggtattagtttcacaggcagtttacttttcagtacataatttaacaggagtgacttggtgggagtggggctttaaactgaaaattggaacaacagcatgatgtggagaaaagttgtgcagcattaagaagtacatgcaaaaattaagtaaccaagttttgtctacatagcagatatgtttacattggatgtcaaaagtaacacagtatttgatataattacagataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289919 - DNA, 4219 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289920 - DNA, 3670 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaataaaaaaaaaaaaaaaaaaaaaaggggggggggtaaaaagttcctaggggcgaggtttcggtaccagtttgtgtaaggggccatgggggcggatatagaggcaggcgcgttaaggtggtggaatgctctggacttgggcctctgggggggctttggccctacgggtagctagaataattcgtttgtacacgtttggtgagtgccgtata

SEQ ID NO: 289921 - DNA, 3760 bp, Homo sapiens
agcggagtacaatgcggccgcggggagcgcgggcccgcgggggaggggagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289922 - DNA, 3279 bp, Homo sapiens
agttcgacggaactctccatgtagggaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289923 - DNA, 4218 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289924 - DNA, 2999 bp, Homo sapiens
aagatggagaaggcagtagacgaagtgggttttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289925 - DNA, 3207 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtgttggggatacatcacgggtcctctaggtca

SEQ ID NO: 289926 - DNA, 4214 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289927 - DNA, 2640 bp, Homo sapiens
tcgaatcgacctcgcccaacttatccagcagaaaagagaccagactgtgatagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289928 - DNA, 3079 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtactcgggaggctgaggcagaatcgcttgagcccaggaggcggaggttgcagtgagccaagatggcaccactgcactccagcctgggcaacagag

SEQ ID NO: 289929 - DNA, 2102 bp, Homo sapiens
gagatcgagctcggtaccggagacacttacgtagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289930 - DNA, 2646 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcattctgtcgactggtcgcatatcattcgga

SEQ ID NO: 289931 - DNA, 2647 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtatggaggtggtctggcttagatgttgccggtg

SEQ ID NO: 289932 - DNA, 1857 bp, Homo sapiens
attcgagcctcggtacccactatcgctaagtaaccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgac

SEQ ID NO: 289933 - DNA, 2700 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaat

SEQ ID NO: 289934 - DNA, 2185 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtacctcaggtgtcttttcgccagtcataaaccgtatgttagaacgtatcgtgacaaggtaa

SEQ ID NO: 289935 - DNA, 2144 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctctactctagctttcttttgttagtgtgt

SEQ ID NO: 289936 - DNA, 2141 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtaagtaaaatgtttagggcctgatctcagtgtttaaaatagactgggagaggctgggcatggtggttcacgcctgtaatctcagcattttgagaggctgaggtggatggatcacctgaggtcaggagtttgagacccacctggccaacatggcgaagccccgttcctactaaaaatttaaaaattagctgggtgtggtagtgggttcctgtaatcccagctgctcgggaggttgaggcagggacaattacttgaacctgggaggcagaggttgcagtgagttgagatcgtgccattgtactccagtctgggcgacagagcaacactccgtctcag

SEQ ID NO: 289937 - DNA, 1840 bp, Homo sapiens
  misc_feature (56)..(57): n is a, c, g, or t
tacacgcatcagccaacaaagagaccaccccaaaacacttaggctagtacgaggcnngggtgagaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaagaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagtatctgccatttgcttcttaaaacctgccaccatcatcttatccataatagtatttgtgccaagaatgttatatttccctggatgtcgagc

SEQ ID NO: 289938 - DNA, 715 bp, Homo sapiens
gaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccaggtaatgattcaagatccctggaagcatgattgataactgtagcttagtctggaaaggtgtgagctttatgttggggtgtcttagtaatccgtaaggaacatgataggcattgacataaggaaaattgaactagtaatggtgaaatgagtctacttacttttgagttttttcaggtgtactaaacaagtcagatgcatttctcataatgaataaaaaattaaaacataagaaaccagcagagggtatccagaatttgtgtattgcttgctacctaagattaggggctagcaacctgtccatttctgctcctctctctcacccccacaaacctaacaagcaattgggctcagagctcttagagagtatttcctttttgtagaacttcagaggacgaggaaacaatcgtggctacaaaaatcaatctcagggctacaaccagtggcagcagggtgtaagtaatttcttatgtgctttatgtacattaattgtattttgagttcctaagatttatcagtcttgaaaaagatcttgtacagg

SEQ ID NO: 289939 - DNA, 298 bp, Homo sapiens
  misc_feature (255)..(255): n is a, c, g, or t
tactactactaaattcgcggccgcgtcgactcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttcttttttttgagattcatattttatttacaagtaaatgaagactgtccctgtaaactctnatttgggatatgaagaacaatataagtcgacgcggccgcgaat

SEQ ID NO: 289940 - DNA, 1129 bp, Homo sapiens
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaa

SEQ ID NO: 289941 - DNA, 851 bp, Homo sapiens
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacgaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaa

SEQ ID NO: 289942 - DNA, 1013 bp, Homo sapiens
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttggacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaa

SEQ ID NO: 289943 - DNA, 1122 bp, Homo sapiens
  misc_feature (1009)..(1009): n is a, c, g, or t
  misc_feature (1020)..(1020): n is a, c, g, or t
  misc_feature (1025)..(1026): n is a, c, g, or t
  misc_feature (1033)..(1033): n is a, c, g, or t
  misc_feature (1039)..(1039): n is a, c, g, or t
  misc_feature (1045)..(1045): n is a, c, g, or t
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggaatntatctttgtanatatnntcattanttcttntctctnacctaagttactttattacatattaatctgttcatttgttcacttgctcattgatgtaataaattagtaatctcaaa

SEQ ID NO: 289944 - DNA, 799 bp, Homo sapiens
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagggggggccgggcccccaattcccc

SEQ ID NO: 289945 - DNA, 731 bp, Homo sapiens
tgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacagtgagtagtttatctcctcccggtggagcccggggttagacccttcctcccgggcgggcgcctcttccgaagaagcttgtagaatgagtcccgggcggggccggtgtgttctgagctcaatccgggcgttccgcgtcgatgtcctccacagctgcggtacacaccgcttgcccacccagtagcctgctgctacttctgcccctcgcagcctccgccagccctctagctggtgagccccaagcgatggaactcattcttgcttccgtggatcgcggcagcagaggcccgaacacgaaa

SEQ ID NO: 289946 - DNA, 1163 bp, Homo sapiens
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaagtgtcatgttatttccaagtttgagttacctagg

SEQ ID NO: 289947 - DNA, 1173 bp, Homo sapiens
  misc_feature (1135)..(1143): n is a, c, g, or t
  misc_feature (1156)..(1172): n is a, c, g, or t
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttttttttaataacaaaatcactgtttaaagaaacagtggcatagactccttcacacatcactgtggcaccagcaactacttctttatattgttcttcatatcccaaattagagtttacagggacagtcttcatttacttgtaaataaaatatgaatctcaaaaaaaaannnnnnnnnccccccccccccnnnnnnnnnnnnnnnnng

SEQ ID NO: 289948 - DNA, 1010 bp, Homo sapiens
ccgaaagctgagggacggaggtcagtgactctggggtctcgggaacccggagacgaaggaagacaccgtgttccttaagagggagtatacgtttcctcgccatttatccaatggagtttcctcttacctacttaacaggaacagggaaagggtgtcccccaacggtacggctgccccgcctcttcctgggggcccacacgtgttacaggaagtgggtaagggtaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaaatgaactatatgcctggcaccgccagcctcatcgaggacattgacaaaaagcacttggttctgcttcgagatggaaggacacttataggctttttaagaagcattgatcaatttgcaaacttagtgctacatcagactgtggagcgtattcatgtgggcaaaaaatacggtgatattcctcgagggatttttgtggtcagaggagaaaatgtggtcctactaggagaaatagacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttgaaaagtcacttttatttttaattattttacatatgcaacatg

SEQ ID NO: 289949 - DNA, 438 bp, Homo sapiens
tctcaggaccagtcttaagtgcttctgtcttaccagaccttccttctgtcccctcacttaacagaccatctgctccggccaccattcccacatgcacatttgtcatgtgtctctactgctgcagctttgctcatcttgcaagaagtccccactcaaacttctgctacagaaagcccagccatcccccaatgggctctcaactgctatccctgtcgtatctcacacacaaactgcttctctgcttagagatcatagagtggccttactgcttctgagataggtgctttgactctgttgtcatttatcttctagattgtaaattcctgagggcggtttgtatgaatgaatgataaaatggaatattaagagggcaatattgtgccttggtttgttcctttttaatttctctttttccacttgttaagactggtcctggaa

SEQ ID NO: 289950 - DNA, 1574 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcgggtgagtcggctttaggcgccgtgggctcaagtggtttagggcacctgggcttgggaagaagtcgtggagagagcctttaatactttatggagctggcggggagaacaaataaaattgcggtagcttgaagggcactgacatgccactgacttgggaaccgtatccgtgggaactcttcgggtgccggcgcgaccaagggcctgtgcgcggctgggtgggagatggaaaggttagaaggtcgcggactagccctgcctgcgactggctcagcttgaccttggaccagtgactttaccacttagatttttctcgtgggtaatatgtggggccacagcaacgtggtctatgctgtcgtccagtttttagactacatctccgtttttgagattttcctagggcctcaacacggtgcgcgagttatcaagcggtaggccaggatatgtttacatgcgcctggattcacctttcagcctactcagaagtaacttttaagtctgatgttttaaaacactaacatttaaaggctttccttcactatccattgcttattttacgaaccttaggattgtcgtattttgctgcaccatttggaatcctaggggccagggtggggacagagagccaagtctgagggtgaagtggcaggtgcccccgggcgatccctgccggatccagttgagggggagaacaaagcatttattatgcataagagagagtgaacagggcaggtgtttgtgtttttgttttctgtattatactgaaaactttttttggttgggggggtgcgggcagtggaggaggggacaaagaagaaaaagaaatgtc

SEQ ID NO: 289951 - DNA, 2997 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcgggaacattaaaatctccccagatgctcactgctctgatcatttcccctacagcaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttatttagcacttaattatatactttcttgactcactttgagacacactgattatgtggtctgcctcaaagacagaatcctagttttggattttagcattactgatctatagccttgcaggggcttaaggatggcagctgtctctctcccttgggatctagcttttgcaaatattgaagggaagagatttctttgatcttataggaatagatccacagttcctctccagatttgcttttatagagaagtgtgtgtcaccaaaacaatggagatacggtcagagaggcccctacccccagaattttaatataattttactttctggggcatttattcttgacaaatactttctctcctatcagctcacttgttcctcacaaaaaccctataagatattaatattattaaacagacccctatgaagcacctcaagtctttctctcttcccacttccattcttgcacaccttttgctagactagtctctgcgttcatcacatcaggtttctaaaataaaagtcccctaataactttctatttgttctctcatcatattgaaccttttttgcctggcttataaggtggccttaaaaccccattttcctctaaacattgtctctgtagttcaggaatatggcaggctcaacactatgcttgagcccatattgcttccctcattagtgatgcctcctctcagaccacccagattctactcattcttcaatttccagcttctccttggagcctttccagatcattagcttcttaaaaatcccagctttctctgaattctgatggtagcccccgttatttggacaattatgtcctggtcttaaagtcctaatgggaaaaaaaagtacatgatggacttcatgtagagaagaaagcactggactgagttttaagacagctgctaaggagctgtgtgagccaaaccaggttactttacctctctggatctatatttgctgatctgttaagtggagacaattgggtcagataatcttggtggtctttgcttattctgaggttcttgtacaacttggcctagttcacgtgggatgggattgaagatcttactgagttcttggatggaaatgtcagtaatgggcacttagtgccttcaggacttgttctatactatcccagaaatttctgatgctaaacttggcaatttttaaatgtcatattccttttctccaaactctttaaccacaagaattcagggaaggttatggggggtgacttagttatctggataatacatattgtggacaatatagcattatccttgggaatgatttcatattgttgaataaataggatcaacttcttgataaaccttagtcccaagcatttcatcttcattggatagtgttacatagtaatatatttatgttttcttttaatcatttcataacttggaatactaacatagtcaaaactctagggtaggtgatacatgagtttctgtagtaatctggttggagacatgttgtaattctgtatatatatgtacatttatcccatgcatgttatgcctaaactaagacggatacccctgaattaagaggtgctgttatacattgaccaggcttaagaatatctctttaaagtgtgtcgacatttaattgacctttggaagttcattctgttaatcatactcaaagtgctaaagctatggttgactgctctggtgtttttatattcattcgtgctttagcatataaattcttcagcataattgctacttatttagcaagagtttcctttatttgaaaatgtgagttgtgcttgtatttttgtgtctttctttctttctttctttttttaaactttgcttcaggctgggtagtggtagaggtttgaattaaaatgttttcctgtcagtagttgtatgagg

SEQ ID NO: 289952 - DNA, 1726 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcggatttcaggtactccactgggcattttctcttcatggagcttatagcaacaaaagtgttttacaaaacaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggaagttcgaggaccttcagaaatcaatccatgggctccacaagcactgtatcaagaggcattcgagaccagtctgggctagagggtgagaccctgtctttatgaaaaaagaaaaagagagagaaaaatgaatatttgatagaggcacaaatcatgcagttcccacatatttgggggttattcctagaaatttcgtgtgctgttgttgggtaaagataggcaatgaggatggagagggaggtaggccatatccagcaattttggactttatgaaacaagaggaagtaaactggagtgtttaaacataaaggtggccaatatgcattttggacagcaaaatcagaaagtagaatgtgaaataactggagaagaaagacaggaagtggggaaaacatcagtttgtcagcacaataatctgggttggaaatagtgagagcctattttaaaacctctccaacattaaggatgttcccttttctaagataggcctactttgattctgtataaaaaataataagacaaagttttcaagcactaagggacactttgaaattagccaaacgtttgttctgtaattccttttgttttttactcaaggcaacagttagatgttagcaaccttgcttttgtacccttttgtctacatagggtatatcaaaagcttaagcagcctaggagccactgaggag

SEQ ID NO: 289953 - DNA, 1287 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcggatttcaggtactccactgggcattttctcttcatggagcttatagcaacaaaagtgttttacaaaacaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggaagttcgaggaccttcagaaatcaatccatgggctccacaagcactgtatcaagaggcattcgagaccagtctgggctagaggtggacatgagagaaagatcccatagccctcttggtcttggttggaacaggaggaaaatgaaaactggacatccatcttaggacttaaacacaggcgacgagcacaggctgtgtagagacgccgcacagtccaagccttcatgcgcgcacagtgagacatttagag

SEQ ID NO: 289954 - DNA, 1095 bp, Homo sapiens
  misc_feature (1048)..(1048): n is a, c, g, or t
  misc_feature (1059)..(1059): n is a, c, g, or t
  misc_feature (1071)..(1071): n is a, c, g, or t
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcgggtgagtcggctttaggcgccgtgggctcaagtggtttagggcacctgggcttgggaagaagtcgtggagagagcctttaatactttatggagctggcggggagaacaaataaaattgcggtagcttgaagggcactgacatgccactgacttgggaaccgtatccgtgggaactcttcgggtgccggcgcgaccaagggcctgtgcgcggctgggtggggtctcacgaattcgtgagaccgcgatagcggtcctcctcccgcaccaggtagcgaacctcgtcatggattctgatgcagnagcgcccatcnatggcaaactcntcaaacagccacttcatggccaca

SEQ ID NO: 289955 - DNA, 3012 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcggatttcaggtactccactgggcattttctcttcatggagcttatagcaacaaaagtgttttacaaaacaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttatttagcacttaattatatactttcttgactcactttgagacacactgattatgtggtctgcctcaaagacagaatcctagttttggattttagcattactgatctatagccttgcaggggcttaaggatggcagctgtctctctcccttgggatctagcttttgcaaatattgaagggaagagatttctttgatcttataggaatagatccacagttcctctccagatttgcttttatagagaagtgtgtgtcaccaaaacaatggagatacggtcagagaggcccctacccccagaattttaatataattttactttctggggcatttattcttgacaaatactttctctcctatcagctcacttgttcctcacaaaaaccctataagatattaatattattaaacagacccctatgaagcacctcaagtctttctctcttcccacttccattcttgcacaccttttgctagactagtctctgcgttcatcacatcaggtttctaaaataaaagtcccctaataactttctatttgttctctcatcatattgaaccttttttgcctggcttataaggtggccttaaaaccccattttcctctaaacattgtctctgtagttcaggaatatggcaggctcaacactatgcttgagcccatattgcttccctcattagtgatgcctcctctcagaccacccagattctactcattcttcaatttccagcttctccttggagcctttccagatcattagcttcttaaaaatcccagctttctctgaattctgatggtagcccccgttatttggacaattatgtcctggtcttaaagtcctaatgggaaaaaaaagtacatgatggacttcatgtagagaagaaagcactggactgagttttaagacagctgctaaggagctgtgtgagccaaaccaggttactttacctctctggatctatatttgctgatctgttaagtggagacaattgggtcagataatcttggtggtctttgcttattctgaggttcttgtacaacttggcctagttcacgtgggatgggattgaagatcttactgagttcttggatggaaatgtcagtaatgggcacttagtgccttcaggacttgttctatactatcccagaaatttctgatgctaaacttggcaatttttaaatgtcatattccttttctccaaactctttaaccacaagaattcagggaaggttatggggggtgacttagttatctggataatacatattgtggacaatatagcattatccttgggaatgatttcatattgttgaataaataggatcaacttcttgataaaccttagtcccaagcatttcatcttcattggatagtgttacatagtaatatatttatgttttcttttaatcatttcataacttggaatactaacatagtcaaaactctagggtaggtgatacatgagtttctgtagtaatctggttggagacatgttgtaattctgtatatatatgtacatttatcccatgcatgttatgcctaaactaagacggatacccctgaattaagaggtgctgttatacattgaccaggcttaagaatatctctttaaagtgtgtcgacatttaattgacctttggaagttcattctgttaatcatactcaaagtgctaaagctatggttgactgctctggtgtttttatattcattcgtgctttagcatataaattcttcagcataattgctacttatttagcaagagtttcctttatttgaaaatgtgagttgtgcttgtatttttgtgtctttctttctttctttctttttttaaactttgcttcaggctgggtagtggtagaggtttgaattaaaatgttttcctgtcagtagttgtatgagg

SEQ ID NO: 289956 - DNA, 3063 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcggatttcaggtactccactgggcattttctcttcatggagcttatagcaacaaaagtgttttacaaaagaacattaaaatctccccagatgctcactgctctgatcatttcccctacagcaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttatttagcacttaattatatactttcttgactcactttgagacacactgattatgtggtctgcctcaaagacagaatcctagttttggattttagcattactgatctatagccttgcaggggcttaaggatggcagctgtctctctcccttgggatctagcttttgcaaatattgaagggaagagatttctttgatcttataggaatagatccacagttcctctccagatttgcttttatagagaagtgtgtgtcaccaaaacaatggagatacggtcagagaggcccctacccccagaattttaatataattttactttctggggcatttattcttgacaaatactttctctcctatcagctcacttgttcctcacaaaaaccctataagatattaatattattaaacagacccctatgaagcacctcaagtctttctctcttcccacttccattcttgcacaccttttgctagactagtctctgcgttcatcacatcaggtttctaaaataaaagtcccctaataactttctatttgttctctcatcatattgaaccttttttgcctggcttataaggtggccttaaaaccccattttcctctaaacattgtctctgtagttcaggaatatggcaggctcaacactatgcttgagcccatattgcttccctcattagtgatgcctcctctcagaccacccagattctactcattcttcaatttccagcttctccttggagcctttccagatcattagcttcttaaaaatcccagctttctctgaattctgatggtagcccccgttatttggacaattatgtcctggtcttaaagtcctaatgggaaaaaaaagtacatgatggacttcatgtagagaagaaagcactggactgagttttaagacagctgctaaggagctgtgtgagccaaaccaggttactttacctctctggatctatatttgctgatctgttaagtggagacaattgggtcagataatcttggtggtctttgcttattctgaggttcttgtacaacttggcctagttcacgtgggatgggattgaagatcttactgagttcttggatggaaatgtcagtaatgggcacttagtgccttcaggacttgttctatactatcccagaaatttctgatgctaaacttggcaatttttaaatgtcatattccttttctccaaactctttaaccacaagaattcagggaaggttatggggggtgacttagttatctggataatacatattgtggacaatatagcattatccttgggaatgatttcatattgttgaataaataggatcaacttcttgataaaccttagtcccaagcatttcatcttcattggatagtgttacatagtaatatatttatgttttcttttaatcatttcataacttggaatactaacatagtcaaaactctagggtaggtgatacatgagtttctgtagtaatctggttggagacatgttgtaattctgtatatatatgtacatttatcccatgcatgttatgcctaaactaagacggatacccctgaattaagaggtgctgttatacattgaccaggcttaagaatatctctttaaagtgtgtcgacatttaattgacctttggaagttcattctgttaatcatactcaaagtgctaaagctatggttgactgctctggtgtttttatattcattcgtgctttagcatataaattcttcagcataattgctacttatttagcaagagtttcctttatttgaaaatgtgagttgtgcttgtatttttgtgtctttctttctttctttctttttttaaactttgcttcaggctgggtagtggtagaggtttgaattaaaatgttttcctgtcagtagttgtatgagg

SEQ ID NO: 289957 - DNA, 2946 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcggcaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttatttagcacttaattatatactttcttgactcactttgagacacactgattatgtggtctgcctcaaagacagaatcctagttttggattttagcattactgatctatagccttgcaggggcttaaggatggcagctgtctctctcccttgggatctagcttttgcaaatattgaagggaagagatttctttgatcttataggaatagatccacagttcctctccagatttgcttttatagagaagtgtgtgtcaccaaaacaatggagatacggtcagagaggcccctacccccagaattttaatataattttactttctggggcatttattcttgacaaatactttctctcctatcagctcacttgttcctcacaaaaaccctataagatattaatattattaaacagacccctatgaagcacctcaagtctttctctcttcccacttccattcttgcacaccttttgctagactagtctctgcgttcatcacatcaggtttctaaaataaaagtcccctaataactttctatttgttctctcatcatattgaaccttttttgcctggcttataaggtggccttaaaaccccattttcctctaaacattgtctctgtagttcaggaatatggcaggctcaacactatgcttgagcccatattgcttccctcattagtgatgcctcctctcagaccacccagattctactcattcttcaatttccagcttctccttggagcctttccagatcattagcttcttaaaaatcccagctttctctgaattctgatggtagcccccgttatttggacaattatgtcctggtcttaaagtcctaatgggaaaaaaaagtacatgatggacttcatgtagagaagaaagcactggactgagttttaagacagctgctaaggagctgtgtgagccaaaccaggttactttacctctctggatctatatttgctgatctgttaagtggagacaattgggtcagataatcttggtggtctttgcttattctgaggttcttgtacaacttggcctagttcacgtgggatgggattgaagatcttactgagttcttggatggaaatgtcagtaatgggcacttagtgccttcaggacttgttctatactatcccagaaatttctgatgctaaacttggcaatttttaaatgtcatattccttttctccaaactctttaaccacaagaattcagggaaggttatggggggtgacttagttatctggataatacatattgtggacaatatagcattatccttgggaatgatttcatattgttgaataaataggatcaacttcttgataaaccttagtcccaagcatttcatcttcattggatagtgttacatagtaatatatttatgttttcttttaatcatttcataacttggaatactaacatagtcaaaactctagggtaggtgatacatgagtttctgtagtaatctggttggagacatgttgtaattctgtatatatatgtacatttatcccatgcatgttatgcctaaactaagacggatacccctgaattaagaggtgctgttatacattgaccaggcttaagaatatctctttaaagtgtgtcgacatttaattgacctttggaagttcattctgttaatcatactcaaagtgctaaagctatggttgactgctctggtgtttttatattcattcgtgctttagcatataaattcttcagcataattgctacttatttagcaagagtttcctttatttgaaaatgtgagttgtgcttgtatttttgtgtctttctttctttctttctttttttaaactttgcttcaggctgggtagtggtagaggtttgaattaaaatgttttcctgtcagtagttgtatgagg

SEQ ID NO: 289958 - DNA, 1660 bp, Homo sapiens
cgcaagagcggagctgcgcgagccgctgcggagggaagggctcctagccaattggggtctttgaggcgaatgcgaggctggggccggttgcctaccggccgcttctcgccgaggcagtccagacttttcccccggcggtgcccgctccaagacagcatctgtcaacgctcctcttctcccctcctcctcctgccgggccgggctccgccggctgcggccgagaggacgcgggacccggcgcggtgagcccatcagctgtcaggcgagcggcgaagcggctggagggcggcgagagacacacaaagaacgcggtgggcggcggcggcgaaaggggacggcaactcctccccgcgcccgccggtgccaccgccggccgtgcttgttccgaggccgcgcagacaatgcggccgggctcgtccccgcgtgccccagagtgcggagcgcccgcgctcccccgaccccaacttgaccgtctcccggctcgcccagccccctcccggggtaggggcgccccctccctccggtggccggcgaaggaagtcggtccgcggccgcagatcccggcaacttgcgaaccgggaaaagtttgcggcgcctccgcggggcggcgcgacgcggcccgcccctcgcgtccgcggtcatcgcgggtgactttctcgactcgtcgtcagccggggccgcagcgcggccggtggggactgcggggcgggccggagtccgtccgagggctcccgcacctcgggctgcggcaccagacatgttggcatcatctcttagttgggccatgtggccagggaacccttcatgaaaccacctctgcagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggaagttcgaggaccttcagaaatcaatccatgggctccacaagcactgtatcaagaggcattcgagaccagtctgggctagagggtgagaccctgtctttatgaaaaaagaaaaagagagagaaaaatgaatatttgatagaggcacaaatcatgcagttcccacatatttgggggttattcctagaaatttcgtgtgctgttgttgggtaaagataggcaatgaggatggagagggaggtaggccatatccagcaattttggactttatgaaacaagaggaagtaaactggagtgtttaaacataaaggtggccaatatgcattttggacagcaaaatcagaaagtagaatgtgaaataactggagaagaaagacaggaagtggggaaaacatcagtttgtcagcacaataatctgggttggaaatagtgagagcctattttaaaacctctccaacattaaggatgttcccttttctaagataggcctactttgattctgtataaaaaataataagacaaagttttcaagcactaagggacactttgaaattagccaaacgtttgttctgtaattccttttgttttttactcaaggcaacagttagatgttagcaaccttgcttttgtacccttttgtctacatagggtatatcaaaagcttaagcagcctaggagccactgaggag

SEQ ID NO: 289959 - DNA, 3067 bp, Homo sapiens
  misc_feature (1121)..(1121): n is a, c, g, or t
  misc_feature (1603)..(1603): n is a, c, g, or t
gcgatgctttcggttatgtgcatcaaagaaggaggatcttgcatgtacctatgcgcacaccaaagcacctgtctgtcaaggcccacgcagtcttaagcacatacacacagtcaactacacacactgacggcacactcacacattcacagacaatttaagattagtctcagatgagcacacactaacacactcatccagtggtgagcttgggagagtgaggaggaattccggcctttgagccatgcttgtttggtgtcaggagggacttgggattcaggggctcagccactgccctgtctgcccaccacctagtttcagcagacaaccccccattttggagatccctggaggcaggctggggatgagaggaatgatgcagccccctgtgtcctgcccaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgaggtaggcgccttccccacctgccnccgccacctccctgtgccctctcttgcggggctgggtcccaaggagggtgtgtctttggatcctggtgggggtatgtgcgtggagccaagggccactggcccccactcctacccttcaccatccaattagtaggcccagacgggggcctgcaagggtcctgagttgtgcgtcactaggcagagagccagaggttggaatgtgggcatcaggcctgccctcagggagctttctggttgactaggccacagcagttcaggagctgattgcatgtgaacaggtacagagaagaagtcctagtggctctctgctggtgctgaggcaggaagggccagaagctggtgagcttccctgaaccctggtgtgcctgggagtcagttccgaagaaggcagctgtcccagagatgtgacaggacctggctgttgtttctctctgaccctaacaggatttatgccctgcatccgcggtgtttttcactgtttnattcttattattcttattctcttggcgtcacatgcgtttagtggatctggaaatcaaaggctgaaggaagcgctgacattgatcgtatctgttaattgtggatattgccagacacagggcccttcttggagcgtatacatgttaagaagggcaacacttagcccccaaaacagtaccccagtgttgcgtttacatgcagcagaaatagctggatggagagagattttgagccagggtctgccaatgccacttcagcctcagggctgagctgggcctggagaggaaagctgctgagccaccgttggagcaaatgactgaggacctctgctgcccctacttctgcccgagagctgagctgacctgattgtgctttggcatcaccacccactctggccccaacatctagccttgccaagttcaggtgctagtcatgaccatgtagagctcaccgtgtacccaaagactgtggcagcttcctggctgctggagctttccaggccccctatcttctgtttattcactcagccagcattaactgagcatggactggatagggttgctgcccttgtggaatgcaccatctggagagagagaggaatgtggtatcgcagacgctacagttgctgccagtttagggatagaagtatcagggatgtcttcccagaagcagtgatgctccaacaacatctcaggcacttggctgtggccacatatcggctgcagaaggagaagcccatgcaaggcacccacagttgaggaagcagagggtggcaagccacgagcagtgccctcaggcacaggattccagaagcatgggcaagagcctggagggtccacatccccacattggttctggggacatttgcaactccttgtcttgagtgtcaacaacaggcagctctttgttcagggcagggcagggtatttggagatgactggtttgccctgtccaaagctgctgctcacactgttgagaggcttgacgcctggggtgggacatgggctgtgtgcatatcggcgaggctgtctggcctggcggctggacaaagcctcctagtggagatgatatttggcctgtgaactgaatcaggtgaaggataggagaagaaaacagcatatttggagacttagtggccagagcatgtcttggcagagaaactggaaggaggctggaatggctgcaccaggcagaaggaagactcctaaagtggggatgacgggtaacctgggtcacatgtgcgagatcttcttgtagcctgggggaggagcttacactgtcctgagagcagtggggagcctcaggagcctgcctccagagtatctaggcattagttacatgccatgttacagatgagattgcccaggcacagtggctcatgcctaaaatcccagcactttgggagaccacagtgggaagatcacttgaagccaggagttccagaccagcctgtctctacaaaaaaa

SEQ ID NO: 289960 - DNA, 1128 bp, Homo sapiens
gcgatgctttcggttatgtgcatcaaagaaggaggatcttgcatgtacctatgcgcacaccaaagcacctgtctgtcaaggcccacgcagtcttaagcacatacacacagtcaactacacacactgacggcacactcacacattcacagacaatttaagattagtctcagatgagcacacactaacacactcatccagtggtgagcttgggagagtgaggaggaattccggcctttgagccatgcttgtttggtgtcaggagggacttgggattcaggggctcagccactgccctgtctgcccaccacctagtttcagcagacaaccccccattttggagatccctggaggcaggctggggatgagaggaatgatgcagccccctgtgtcctgcccaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgacgcgcaatgttggtggggatcctgctagagt

SEQ ID NO: 289961 - DNA, 2991 bp, Homo sapiens
cgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtacaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaaaagcttg

SEQ ID NO: 289962 - DNA, 3002 bp, Homo sapiens
tgggatctgaacatggcggcggtggtagctgctacggcgctgaagggccggggggcgagaaatgcccgcgtcctccgggggattctcgcaggagccacagctaacaaggcttctcataacaggacccgggccctgcaaagccacagctccccagagggcaaggaggaacctgaacccctatccccggagctggaatacattcccagaaagaggggcaagaaccccatgaaagctgtgggactggcctggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtacaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaaaagcttg

SEQ ID NO: 289963 - DNA, 2735 bp, Homo sapiens
cgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtacaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacaactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaaaagcttg

SEQ ID NO: 289964 - DNA, 1514 bp, Homo sapiens
cgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaaaagcttg

SEQ ID NO: 289965 - DNA, 3633 bp, Homo sapiens
cctgggtgacagagcaagacccaaaaaaagaattatagatttgcatttttggcacaaataccacagaagtgatcttatgccctcctcagtgcatcataccaagaggcaaatgatgtctatatattgttactggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactggtaaggggctcccgtcttccctggcccacccttgtcccagctgggcttgccaggactgggcccattgaggacggccggggccagagatcaagaagtcagtacgggccggcacccgccttcctcgtgaagtcacctggacaccagcagggagggaggagaggggacagtctcccaccactccattgatcaagcttctgaagccccagagggcagggcagtcatttctctttcatttcatgggcatgtattagatacctactgcacactgggcatggacaaaagttatgactcttccatcaaggaaattctaagaccaataggggaggtagccctgtatcaaagtatataacagcggaggcaagagggttgggagttcaagcccaacctgggcaacatagtgagaccttgtcttcaaaaaagaagtatgtgatatttaggtaacagttggcacagggaacagggatgggaggcccaggcacggtgtgatcagatccacttggagaattgaaagatgatgacctgagctgagggttcaggaagctcggctggcattggccagcttgagttgttgggggcgatgttctgggcaagggaacagcttgaacaaaggcctagaggtgtggacaacttggcttagtccagaagccacagccccagcacttaaaggcctggagatgctgtggtaaagaagggggcttaggtacagttgcccctcgaagccccctgcctgtctctgctgtcctgcagggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggccaaaagaagggggcctgttggaggctgggaaccccgcagcgcgaggctgcctcatcaacggcaagaggaaaggaggggtctcgggacatctccagaccctaccaactgggagggtcccctcctccttccctactcctgggacggcagcaaggacatgggggctgctgttagcttctccgtcaggaggcctcatctcactgtagccctggaacccagggtccatcttgcccttcccccatccatggttgggaaagaagctcagcccctcacagtggcctcaagtgtgatgccttacaaaagcaccactcagatgggcagctggactctggtgtcctgagactctgccctcttcccacagcctccctgccccacccatccctgcaaagccatttttcagacagagccattcctaagaacactgaagggctggaatgctggctggccactctctgcctcagtggcctccctacagcctggaagaaggagggtcctgattgccaaggaaacctcctcattgggctaaggagacactggagtctggagtgtggagccccacagtcttgcaggtcacatgctctccttgcacatctggcctggttgtacccactggcctctgcctctgccctgggccaaaagggcccctccttgccaggggagagacagccacggtcctctttggccgatgctgtattctcattttggcccttgttcttaggcccgtctgcccgccttcctccatctaacctttcctgttttatccgcagcccttttcttctttgagttagtaaagatttattctgtaacctgacactcatctggccctttgcagtttgccagccatattcccatgtgatttcccactggatccaggcccccatccggctggcaggagggggctctgacgtacaggttggaaatcagaagtctgtgagagcgcgggagtgcatggcagctctgggtcccagacctggcccgacccctctgcttcacctccagctctgctgctcctctactcttgggtcgagatccctttggagccacagcgaggaaccctgtggtcctcaggcaggtgtaccttgagtcagccaggagccctcttttcctgtgtcaaagcctgccctcgggctctgctcacctctggtgaccctccaagatgcccctgccctcagtttcccctcatgatctggcctctgcccccttctctagccacagcctctagtacactttagcaataccaccagactagttagagttccccactcaccaagcaagacatgcagtttcatgcctctgtgccttcgctcatgctgtttcttccgactggaatgccttcccctgctcctcctgccttgtctgcctggcaagttcatctctcacgatcccctcaaaggccccctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaaaagcttg

SEQ ID NO: 289966 - DNA, 1596 bp, Homo sapiens
cgcggggggccggggccgggccgttgcctagcaacgccgagccccgcccggccggcgcgtgcctgcccccagcatggcttggcagggctggcccgcggcgtggcagtgggtcgccggctgctggctcctcctcgtccttgtcctcgtcctacttgtgagcccccgcggctgccgagcgcggcggggcctccgcggtctgctcatggcgcacagccagcggctgctcttccgaatcgggtacagcctgtacacccgcacctggctcgggtacctcttctaccgacagcagctgcgcagggctcggaatcgctaccctaaaggccactcgaaaacccagccccgcctcttcaatggagtgaaggtgcttcccatccctgtcctctcggacaactacagctacctcatcatcgacacccaggcccagctggctgtggctgtggacccttcagaccctcgggctgtgcaggcttccattgaaaaggaaggggtcaccttggtcgccattctgtgtactcacaagcactgggaccacagtggagggaaccgtgacctcagccggcggcaccgggactgtcgggtgtacgggagccctcaggacggcatcccctacctcacccatcccctgtgtcatcaagatgtggtcagcgtgggacggcttcagatccgggccctggctacacctggccacacacaaggccatctggtctacctactggatggggagccctacaagggtccctcctgcctcttctcaggggacctgctcttcctctctggctgtgggcggacctttgagggcaatgcagagaccatgctgagctcactggacactgtgctggggctaggggatgacacccttctgtggcctggtcatgagtatgcagaggagaacctgggctttgcaggtgtggtggagcccgagaacctggcccgggagaggaagatgcagtgggtgcagcggcagcggctggagcgcaagggcacgtgcccatctaccctgggagaggagcgctcctacaacccgttcctgagaacccactgcctggcgctacaggaggctctggggccggggccgggccccactggggatgatgactactcccgggcccagctcctggaagagctccgccggctgaaggatatgcacaagagcaagtgatgcccccagcgcccccagcccagcccactccccgcatggggaggccgccaccaccaacacctcatcatccttctcatcgctaacaccaccacctccatcggcacccaagcgggcatcatccccccacactgctcaggggaggggagggatcaggcgatgagactgtgaggcctcctccaggaaggcaacccctgtgcccctcccctccaggctacctctgcactttgtcaatgcttctcttgtggcacttatcacactgtattttacttgtttacatgtttgtctccccttctagactgtgaatccttaagggcatggactgtatcttatgcatctctgtatttctgcgcctagcacggtgcctagcacacagtaggcgctcaataaatgttgaatgaatgaatgatttaatcaagacttgatcacccaaaagcttg

SEQ ID NO: 289967 - DNA, 2007 bp, Homo sapiens
cggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcagccagacaagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatgtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatt

SEQ ID NO: 289968 - DNA, 381 bp, Homo sapiens
caagccagtagaagactcaggcttcctctccccaaattcagggcattctccactccaaggcctgtgtgtagaacacgtgggttacaaaggcttgtgggaaaagctaccaatggaaactaccccccttaccaccatcaccgtggcctagcttggtgtctgttcccctgggctctttccttaagcatgaacatccatcaccctcctaacccccaggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggaaggaggg

SEQ ID NO: 289969 - DNA, 734 bp, Homo sapiens
cggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtagccttcaaagcctctgcgctctgggagaggggaaggcctcgggctcatagttctagaggctcctcaagcttcagaggactgctccttccgcctgaactagccacgaggagactacaagttccgttgtacaccgcggctccggctgcaaaagcctggagcgttgggagcatggggctgatggaggcatggcgggagatgtagtctggagctcataacggttagtagtaatagttgtgattcagttcagtggagtggattgagcgttgtgatccaaaggaaggtaggacgtattgggagctctggtgtggggcactgccaggctctggggcttactgggagctgttgcttgtggcgctggggcaccatgagaacagtagtatggatccctgtgggatattaagggagctgagatcctcaagccctacaaaatgtttcctgcaggacatgggaaaaaagaatc

SEQ ID NO: 289970 - DNA, 2115 bp, Homo sapiens
cggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcagccagacaagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatggcagtgttttaggtgctgaggattcagcagtgaacaaaacagaccacaaaaccctgctcttatggagcttatatgctagtggaccattaccctcttgcgctgttgcagtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatt

SEQ ID NO: 289971 - DNA, 472 bp, Homo sapiens
cggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtggtgtcagcaaaagcacaacatctggggaggagctagtagtccaggttcccgtagtggatgtgcaaagcaacaacttcaaggagatgtggccattcaacgcctccgggccattcaagcccggaggcgttgaatggcccggtgaatggccgttttataagcattgggtaggtaaaggaaaattacagtcaaagggcggttggccattcaacgcctccg

SEQ ID NO: 289972 - DNA, 2174 bp, Homo sapiens
cggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcagccagacaagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatgtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatttgaccagcttcatctttggttatttcttattgcagctctgtaaggacagactgttcccaaagctccagccatggcaggaagggaagcaaatcagtccctgtataaaccatttaaccaattgaatgtatcacatgttgataaatacatagaagcaggccctagggcct

SEQ ID NO: 289973 - DNA, 2353 bp, Homo sapiens
cggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtagccttcaaagcctctgcgctctgggagaggggaaggcctcgggctcatagttctagaggctcctcaagcttcagaggactgctccttccgcctgaactagccacgaggagactacaagttccgttgtacaccgcggctccggctgcaaaagcctggagcgttgggagcatggggctgatggaggcatggcgggagatgtagtctggagctcataacggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcagccagacaagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatggcagtgttttaggtgctgaggattcagcagtgaacaaaacagaccacaaaaccctgctcttatggagcttatatgctagtggaccattaccctcttgcgctgttgcagtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatt

SEQ ID NO: 289974 - DNA, 2133 bp, Homo sapiens
cggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcagccagacaagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatggcagtgttttaggtgctgaggattcagcagtgaacaaaacagaccacaaaaccctgctcttatggagcttatatgctagtggaccattaccctcttgcgctgttgcagtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatt

SEQ ID NO: 289975 - DNA, 2044 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgcgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtc

SEQ ID NO: 289976 - DNA, 911 bp, Homo sapiens
  misc_feature (896)..(896): n is a, c, g, or t
  misc_feature (911)..(911): n is a, c, g, or t
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtatttttattttatttcaaacggcaactactttgagtaaacgattcaataaaaagaaacgttactaacagtgtattctttgtaagtgacatgactaatgtactttgtgctggttgttgagactcagcagggaaataaagatccttctgtgcattattcttataaaactgaaccattgaaaacacatttatatgaacaatgatcattggggaagctcaaacaatatgaaaaatagttctaactcaaaaccttgtgttatttctacattaaaaanactaatgcaactcan

SEQ ID NO: 289977 - DNA, 490 bp, Homo sapiens
tcgacccacgcgtccggacccacgcgtccgcaagcactgtttggtagcttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttatccccgccggaagtataggaagagagcaagcggattcgaacctatctgctttcaagctgatcatgatgatgaaacttag

SEQ ID NO: 289978 - DNA, 1846 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgcgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtc

SEQ ID NO: 289979 - DNA, 2086 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagttcacagacaattcagtcctgaagtcattatgttgggcagagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgcgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtc

SEQ ID NO: 289980 - DNA, 2251 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagataaagaaatgaagcttcttatccaagatgctcaaggaaataaaatgtgagtcaaggattttatatccagccaaactgatttcagatacaaaaaggacggataaattgtcaacaacacaagaattctcattagccattccttaggaatcaaccagagaatgaaatcattcaaccagaatgacaagagagacagcaacttaaggattgacgcatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgcgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtc

SEQ ID NO: 289981 - DNA, 2354 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaacggagtctcgctctgtcacccatgctggagtgcagtggccagtggcgcaatctcagctcactgcaacctccccgtcctgagttcaagcaattctcctgcctcagcctcccgagtatctgggactacaggcgtgtgtcaccatgcctggctaatttttgtatttttagtagagacagggtttcgccatgttggccaggctggtctggaactcctgacctccgttgatccacccacctcggcctctcaaagtgttgggattacaggcgtgagccaccatgcccggcctatatactgcgttgttacaataaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgcgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtc

SEQ ID NO: 289982 - DNA, 1269 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaacggagtctcgctctgtcacccatgctggagtgcagtggccagtggcgcaatctcagctcactgcaacctccccgtcctgagttcaagcaattctcctgcctcagcctcccgagtatctgggactacaggcgtgtgtcaccatgcctggctaatttttgtatttttagtagagacagggtttcgccatgttggccaggctggtctggaactcctgacctccgttgatccacccacctcggcctctcaaagtgttgggattacaggcgtgagccaccatgcccggcctatatactgcgttgttacaataaagtaagctagagaaaagaaaatgttattaagaaaaaaaaaaaagaaaaaagaaaaacaaagaacaacagaaaaaaacaaacaaaaaaagaaaaaaacgcgagaaaaagaaacaaaaggagaacaaaaaaaaaaaagagggggggggggaaaaaaataacatccacagggagcacagtagacccacacctattgttctgagaaggagacccacataaagggagtaattaaaataacacagggcggcgtattaaaaaaatggtggaggagaaaaatgatgagcagtatgtaggagaacacattgtgggtggggaatataggaacaccaaaaattagaggcgaggagataaaagtgagtatgtgaaaccagtatttggggagaattattgttttaatcatagtggtataagcaagggatgataagataatagaatgaagctggagagagtaagtagaaaaggagtgtctggagagagataatagagaaaata

SEQ ID NO: 289983 - DNA, 1096 bp, Homo sapiens
  misc_feature (1081)..(1081): n is a, c, g, or t
  misc_feature (1096)..(1096): n is a, c, g, or t
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaacggagtctcgctctgtcacccatgctggagttgcagtgagccaagatcgtgccactgcacaccagcctgggcaacagagcgactccatctcaaaaaaaaaaaaaaaaagaatcatgtttctatgataacaggagtgaagaaggaaaaaggataagtggaagcaaatgtgtttgtaggtttgttgactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtatttttattttatttcaaacggcaactactttgagtaaacgattcaataaaaagaaacgttactaacagtgtattctttgtaagtgacatgactaatgtactttgtgctggttgttgagactcagcagggaaataaagatccttctgtgcattattcttataaaactgaaccattgaaaacacatttatatgaacaatgatcattggggaagctcaaacaatatgaaaaatagttctaactcaaaaccttgtgttatttctacattaaaaanactaatgcaactcan

SEQ ID NO: 289984 - DNA, 823 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagataccattccttaggaatcaaccagagaatgaaatcattcaaccagaatgacaagagagacagcaacttaaggattgacgcatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctggacagtaaagtaacattatggggatgttcccaagagcctccggatcggtcgc

SEQ ID NO: 289985 - DNA, 1474 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggtaagagtgatacaggaatttaaaatgttcagctagctagcttgccagaccagttatatgtaaaagaataaattatgattttattctgaggagttatacttttaatccacatttgtagtaggatttatttaatagagaatagcacagcctagattgttagacagcatacaatgtatgaatgaatcaatataatactgtgcaacttgattggtataaattctgtttcttttgcatatgaccttcatttatttaacaactgaaaatctgtggtgaattaaaataatttcttgaaacaatcttttgggtaagaaataaaatataggcatttaatcataaaatataatttgtatatgttggttta

SEQ ID NO: 289986 - DNA, 2163 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagttcacagacaattcagtcctgaagtcattatgttgggcagagagttttgggactggaattaaataaagacagagatgttgaaagaatccacggcggtggaattaacacccttgacattgaacctgttgaagggagataccattccttaggaatcaaccagagaatgaaatcattcaaccagaatgacaagagagacagcaacttaaggattgacgcatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtcacagacaagaaatattagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgcgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtc

SEQ ID NO: 289987 - DNA, 1951 bp, Homo sapiens
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagagttttgggactggaattaaataaagacagagatgttgaaagaatccacggcggtggaattaacacccttgacattgaacctgttgaagggagatacatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagtttcctggtctccacgttatgactatatcttggcaacagcaagtgctgacagtagagtaaaattatgggatgtgagaagagcatcaggatgtttgattactcttgatcaacataatgggaaaaagtcacaagctgttgaatcagcaaacactgctcataatgggaaagttaatggcttatgttttacaagtgatggacttcacctcctcactgttggtacagataatcgaatgaggctctggaatagttccaatggagaaaacacacttgtgaactatggaaaagtttgtaataacagtaaaaaaggattgaaattcactgtctcctgtggctgcagttcagaatttgtttttgtaccatatggtagcaccattgctgtttatacagtttactcaggagaacagataactatgcttaagggacattataaaactgttgactgctgtgtatttcagtcaaatttccaggaactttatagtggtagcagagactgcaacattctggcttgggttccatccttatatgaaccagttcctgatgatgatgagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgcgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaatctggcttaaacatgaaatgctgtaataaaatttctatgttattgtc

SEQ ID NO: 289988 - DNA, 815 bp, Homo sapiens
  misc_feature (800)..(800): n is a, c, g, or t
  misc_feature (815)..(815): n is a, c, g, or t
gcactgttggcctactggccctgagctctgtcatggcgacgtccagtgctccagccggtgtgaggacacgatatgctggggtttttgtccgcacgccaaacgggtttggaggaccctcttcgccttcggagagcagagtcaacacggagcatgttatcaggtggttcagatggtgtgattgtactttatgaccttgagaactccagcagacaatcttattacacatgtaaagcagtgtgttccattggcagagatcatcctgatgttcacagatacagtgtggagactgtacagtggtatcctcatgacactggcatgttcacatcaagctcatttgataaaactctgaaagtatgggatacaaatacattacaaactgcagatgtatttaattttgaggaaacagtttatagtcatcatatgtctccagtctccaccaagcactgtttggtagcagttggtactagaggacccaaagtacaactttgtgacttgaagtctggatcctgttctcacattctacagggtatttttattttatttcaaacggcaactactttgagtaaacgattcaataaaaagaaacgttactaacagtgtattctttgtaagtgacatgactaatgtactttgtgctggttgttgagactcagcagggaaataaagatccttctgtgcattattcttataaaactgaaccattgaaaacacatttatatgaacaatgatcattggggaagctcaaacaatatgaaaaatagttctaactcaaaaccttgtgttatttctacattaaaaanactaatgcaactcan

SEQ ID NO: 289989 - DNA, 436 bp, Homo sapiens
attactgagcgctccgtctcattcccagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggagttttgccatcttgggatcctcaagagtcagctc

SEQ ID NO: 289990 - DNA, 689 bp, Homo sapiens
tcctcgtctcgaatcagtgacactgacggcatggtgagacttggtggcctgaggaagactgtgaagagatcgtccctctgaaatggaggaaaggggttgactactgagagccctgttggggcctctgcctgttaattacatctcctctttccaaggctggacacagactgggggtttaggggtggggtgttctcccaacccctcagctgcatgcccagcacgggcagtccagtgcagtagcccagacacacacacgcatgtacacacaagcatgcacacacacacggtaaccagcaagccaggaggccccagcagaggcccgtgtgtgatgctgtgaactcccagaggagaggagcttgcgggggcctggaagggtgggccaggctcggactgtggagcagggcaggctaaagggcttgaaggccctggacgtgaggcctggtctgagcacaggcctggaggtcggcctggggactcatgcaggctggtacaggagagaggttcctgaggcagataatgccgtcagcactacttaatataacactcagaaagcccggcctcctgccatgggcacaactctgcagatttgagggtaaatgccactgcagggctattctctcgtccccgtcttgacttcccactctggcattgtctcgtggcctctgtcttagctgtctgtagtgccaact

SEQ ID NO: 289991 - DNA, 3156 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 289992 - DNA, 3069 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 289993 - DNA, 2784 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 289994 - DNA, 3251 bp, Homo sapiens
  misc_feature (55)..(55): n is a, c, g, or t
ccacgaacacccggaccatctatgagcgtacactatgaaccccctgggaatttantagcagtgtcggccggaatcagggatcgactggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgcaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 289995 - DNA, 3028 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 289996 - DNA, 1548 bp, Homo sapiens
gtacggggatcatgaaaagcattactaaggagagtgatggtgactaagggaaaggacagccgtcggggagataatagcgtggaaagacgaggctgaacatcaggtgaaagaaatgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 289997 - DNA, 1508 bp, Homo sapiens
  misc_feature (22)..(22): n is a, c, g, or t
  misc_feature (73)..(73): n is a, c, g, or t
  misc_feature (85)..(85): n is a, c, g, or t
  misc_feature (98)..(98): n is a, c, g, or t
  misc_feature (172)..(172): n is a, c, g, or t
  misc_feature (243)..(243): n is a, c, g, or t
  misc_feature (280)..(280): n is a, c, g, or t
  misc_feature (319)..(319): n is a, c, g, or t
  misc_feature (345)..(345): n is a, c, g, or t
  misc_feature (384)..(384): n is a, c, g, or t
  misc_feature (389)..(389): n is a, c, g, or t
  misc_feature (399)..(399): n is a, c, g, or t
  misc_feature (408)..(408): n is a, c, g, or t
  misc_feature (412)..(412): n is a, c, g, or t
cgacttggggcccgggccccancaggttcttgggaacccccggccaccgttcccttgttccaaaaagccaagnacttgcgggganacctgccccttgnaatggtgggtttttggggaacacccgaggacccttccaattccattatttgattgaagcggaacccaaaccagnggaaccatttttgcccttcccctccccccccttcccctttttgaaatttgaaaatgggccaccatttaaangaccctttggtcccaccggctttccttccacttgggnacttggagaacccttccggtttcccctttccaccccccncgcggttgtccggcccaaggcccctncttgggtccccaggcccaagaggcccccccttggctttnctccncggcccaccnccacacccncttncccccaacccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 289998 - DNA, 1040 bp, Homo sapiens
  misc_feature (891)..(891): n is a, c, g, or t
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgagagaaagagccccnagaaaaatgagtccagcaatgcctcctacacctacctctctctgggcttctatttcgaccgcgatgatgtggctctggaaggcgtgagccacttcttccgcgaactggccgaggagaagcgcgagggctacgagcgtctcctgaagatg

SEQ ID NO: 289999 - DNA, 580 bp, Homo sapiens
gacgcctccagcaacaaatttgtatttggccagaacatgagcgagcgagttttggtgagtggctgtgttgggaatgttctcagggaccagaggctctcggcgccagccacaggtcaaggggacatggagagcagggctgctgtgtcgtcctatgtgagatggggatgccttcagtagcaagtgagagagggaagaccctgctcagactcagcctgaaaactggccagggccactggctgcctacgaactggcattcgcttttcccggctcctccgtgctgaccagggccaacttcatcccaagatgggcttccctggaggctgcagggtcctgctggcagtcggggtccatggttcctccccaccaggccaactgacaaaagtcctgtgggacggagccagccgtgctggtggacagggttgctggcctccctgctcctgtgagcataaccgcggccaaggccttgggtgcacgaaaggcccatctccgttcccaggagcccagccagcctgggagagggttctagaatggtttgcctacctctttacacatgttcctttttcttcctgattccacccag

SEQ ID NO: 290000 - DNA, 587 bp, Homo sapiens
ttcatcggggggatgtttgagctttaggctaaaatcctggctctcattcgggtgctgggctctgggaactagctgcccgtggtgcatgttgggatatttgttacggccccgagagttgctcggctgccgtgagcctgatgccctctgaccccggctgtgtgctccttgtttcagaggtcagctggcggctccagtcctgaaggcggagaaggtaaggagctctctaacacctttgaccatcttcagttttaaagacagaagcaacctgatttttctcctcctcttctcatcattttctgtagattctgacagagaagatggaaattactgccctcctgtcaagcgagaaagaacatcctctttaacccagttcccaccctcacagtcaggtaaaatatgcaaacttacggaatggtgaaagcgtttatgcttacaaacccgccattcccctcagtgccgcgcatccgtctgctgtgtccttcctgcccagctccggttagagtcgatctgaggctcgggctctgtcaggagtgaggtgagagcttgtccagagtgcagcatcaggggtcctcgtctcgaatcagtga

SEQ ID NO: 290001 - DNA, 836 bp, Homo sapiens
  misc_feature (687)..(687): n is a, c, g, or t
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgagagaaagagccccnagaaaaatgagtccagcaatgcctcctacacctacctctctctgggcttctatttcgaccgcgatgatgtggctctggaaggcgtgagccacttcttccgcgaactggccgaggagaagcgcgagggctacgagcgtctcctgaagatg

SEQ ID NO: 290002 - DNA, 3360 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagtcccctgcagagcaaaaaaacttgtcggattcgggagaggagcctcggggggaggctgaggccccccaccatggcacgggtcaccccgagtcagctggcgagcatgccctagaacctcctgcccctgctggcgcctcagccagcactcctccgcctcccgctcctgaagcccagcttcctccttttccgcgagaactggcagggaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 290003 - DNA, 2658 bp, Homo sapiens
tctagaaagatcacttgtaacttgacccacgagccctggaaagttcctttaaagagaggctgtctgagcagggaggttgggacccctgactgtgagcgtcgtgtgttcagaaaagtgggcagtggtggcacgggagcaggctaggcggggtgcatcgggcgggctccatgcccagcagtagcgcacttggttcagcctgtctgtccttcatgttctggcccccacataccacagtgttcgccccagttagcagggtggctgcattccagcggcgcgctgctagtgagccggctgctagtgaggctgccggggatgctgcacagggcagggcacatgcaagggtccttgtcccatctgcctttggcagagggacttcctcagcatggctgttttgaaaaacaggtgcaaaatgtgcctgtacgtgaccccacaccgagtcctgagcctccaggtagctgcctgtgaatgcactgctctcctcccacagtctccacttgactgttgagtctgccggcgccccgccacgttactgtgctaactggattaattcacaggcgtcggtcactgggagtttcatgtaatcacatgtaaaaataacagtagccagatctcctggccagctgttaaaaaaagacctcaagtttttaaaaaagtgcttccctgcaaagtctagcctgcaaggggcatgaaatgggatgccaggggtcagtctctgaagcgcctgggggcaggcaggggtccacgggcactgggaaggccgccttctgttcctaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccaggtgtgtgtctcggtgtcagcggccagcctggcatggcgatgcaggtggccgcgagggcttctgccagagaggggtctgtggtccccgtgcccgactcaggcccagaatccaggttgctctcaggcccctctctctcattccccactctgggcacaaccttgggtgggccagggtggtgggccttgtcctgggattcactggacgcctgagacaggaccagagttctgtggggttgtccaggggcccatggaggctacagcccagcccttggagtgtgccctctgtcttgtggacctcatgcccagagcagaacagacgaggccagaggcgactcaggcgcccccttattctgggtttgggcacctggggcaaagacctcatcatgtccttgactgacatggctgggggtaaagctacccacggaccagctgcccctccaggtgtctcagaagaaagcgtgtcccgactgggagatgggcgggtagagcaggtggaaggtggcttccctcatgctgtggggcccctccatcagggcgagctaagggttaatgttttcaatggcacagggaggtgtgtggcttcctgcctctgacacgccaccccgtgcacagtggcggaggcccctccactgtgccctctgtgtcagtgtgtgctccatgggtacccatacatttgcctggccacgttcccacgtgacgcccacactcattgcacatcttctcttcagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactaggtgagctgccgacggcgggggctgtggccgggtccccatggggagggctggggactatgcaattccaaagggaatgaagcgggggagatcctgaccctacccttgtgagagtcaaggcacagagtcggtctcccatgagagccgccccccaaacccccctccctgcacccagccctcaacaccaccctcacacactggctccagctgccagctcgtccgtgaccctcttagtgtcaaaatggacaaaagtctatggaagtttttaagctgattttctgacaaagtggcaggtttatgat

SEQ ID NO: 290004 - DNA, 569 bp, Homo sapiens
cttctcatcattttctgtagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacgactttaagtgatcagggtaccgag

SEQ ID NO: 290005 - DNA, 3654 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttggggcccctttggcccaagctttttttaatttgggaaattttttttttggggcccaaatttgggtttatttggcaaattccccttaaggggggggttttaaaaaaaaaatggggggggttttaaaaagggggaatgggaaaaacccgggggttaccaaatttaaagggtttggaaaaaatcccctttttcaaagggggggaaaaaaaaaaagggccccaaccgatccccttttcaaaaaattggccacctttaatgggaaaggaaaattggggggcttatttttttgtaaaaatcgcggtaaaatttttgttaaaaagatttttttttaaccaaaagggcaaaaggggaaaaatcctttttaaaaaaa

SEQ ID NO: 290006 - DNA, 2352 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtgcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 290007 - DNA, 2963 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacacagcaagcctttgtatttgggcagaacttgagggacagagttaagctgataaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagttttgagccccccaaaattaaacgaggtcagttcagatgccaacagggaaaatgcagctgccgagtcagggtctgagtcctcgtcccaggaggccacccctgagaaagagtccctggctgagtcggcagccgcctacaccaaggcaacagcgcggaagtgtttgttggaaaaagtggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 290008 - DNA, 1583 bp, Homo sapiens
  misc_feature (47)..(47): n is a, c, g, or t
  misc_feature (49)..(49): n is a, c, g, or t
gatgtaccgacaaactgaccgattgcatattgtccctggctcctttnanggggcccacccgacagctggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccaccccaggttcctccaggccaagtcatggggtgatgaggagttggggccctgtctgtcctaggcctggagagtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaa

SEQ ID NO: 290009 - DNA, 770 bp, Homo sapiens
agggcaggctgctctgcagggcaggcgatccggggctcgcctccgcgcggcattcagcgcgcaggcgcgagctggccgcctcacacggagtcggcttgttaagtgcgcacgcgcgggagtttaaaaaagaaagcaggcgagcctgggccggcgcggggccttgtgggagggcttaaggaagtaaaatggcggacctggcgaacgaagaaaagcctgccattgctccgcccgtctttgtgtttcagaaggataaaggacaaaagaggtcagctggcggctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgctgcatggagaagtccttccgaagctgccgatgaggtgtgtgcacttgaggagaaagagccccagaaaaatgagtccagcaatgcctctgaagaggaagcctgtgagaaaaaagaccccgccacagtttatgtagcttacctcctc

SEQ ID NO: 290010 - DNA, 1938 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290011 - DNA, 2218 bp, Homo sapiens
cagatagcccaccaggggtggggagggtgagcagggacagggcgcccccactgacttgggaccctcctcctccaggcccacacctcagcacccaggacatctgggccccccgcccccagcgctgtctagtttggttgcctggccgtcactcccagcctggttcccactcctgtgtcttctggggatggccctcaaggacggcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccagagcctctgcccctcccgagacacccgctacctggtgttagcggtggaccgccctgcgggggcctggcgcggctccgggctggccttgaccctgcagccccgcggagaggactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggaggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggcccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggc

SEQ ID NO: 290012 - DNA, 562 bp, Homo sapiens
aaaaaaaaaaaaaaaattagccgggcgtggttggtgacgcgcgcctgtagtcccagctactctggaggctgaagcgggaagatcgcttgagtccaggaggtcgaggctgcagtgagttgtgattgtgccgttgcactccagcctggacaacagagcaagaccctgtttgacaaaataaaaaagaaacaaccaagattcgttggggtcgaatcgggatcgcggctgaaatggtttcggccgccttccttgtagccgagaacgcttctgtatgctcatctatacctgttagttgactggggctctgtgatgtaattcctgtgagcctcagttcccttaaaatgggagtgacggcttcaacatcatgccaaaggcgaccagaacacgttagctggccccattttgcaggtgcaccccgctgtgaccgttgttcttgtgtatccttggacgacaccaaacagccaggcggagctctggaaaataggttgttggctaggttaaggagagaacggtgttgccacgaaaaactaattccttctcaatggtctagtcccaggtcccagag

SEQ ID NO: 290013 - DNA, 250 bp, Homo sapiens
tagagacgaggtttcgccatgttgcccaggctggtctcgaactcctgaccaggtgatccacctgccacggcctcccaaagtggtaggattacaggcatgagccactgcacccggctaatttttgtattttttgtagagatggggttttaccaggttggccaggctgtcccctgatctttaccttagtaagtaacagatttcttcatggatttatcaatttgtagacatcatctgctgatttcttgtcacg

SEQ ID NO: 290014 - DNA, 1639 bp, Homo sapiens
cggacgcggggtcgacccacgcgtccggacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290015 - DNA, 1635 bp, Homo sapiens
ggcacgaggccaggggcaggggctacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290016 - DNA, 2255 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgcagcgctgccctactgtgtcagtgtgtgtgggagtgccaggcacagcaccatcccccagtttgggccgactggggagggcctggggcccgccaggagacacctgtgggaggcctgagagatggctgtaccttggagatggcctggtggaggacagaccccaccagccagctaggaggggatctggggtcctgttctggggagggaagagcagatcctgccccgagggtccggacgcgccccagctcgcgccccttcccatatttattcggaccccaagcatcgccccaataaagaccagcaagcaaccggc

SEQ ID NO: 290017 - DNA, 2412 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgcagcgctgccctactgtgtcagtgtgtgtgggagtgccaggcacagcaccatcccccagtttgggccgactggggagggcctggggcccgccaggagacacctgtgggaggcctgagagatggctgtaccttggagatggcctggtggaggacagaccccaccagccagctaggaggggatctggggtcctgttctggggagggaagagcagatcctgccccgagggtccggacgcgccccagctcgcgccccttcccatatttattcggaccccaagcatcgccccaataaagaccagcaagcaaccggctggggtgtccgtgcgtgttagggggcccgtgggacctcccttgccgtctctcctcgcgcacggcccgggtccgccctgtagcgctcgctgtctctcccctgcctgaagcgccccaccaccgtctttcaggccccggacttggtgccgggtccaggcg

SEQ ID NO: 290018 - DNA, 2025 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccgccaaaaaaaaaaaagaaaaaagaaagaaacaaaaaaaaaaaaacggggaggaggagaagaaaacaaaaaacaaatggagaaagaggagaggaggagggggggggggagtcgcgaaggaggagtcgccgcggggggggcgcaggcgagggggcgacgaagcgacggagggttgggaaggcgagggggggcaccgaa

SEQ ID NO: 290019 - DNA, 1487 bp, Homo sapiens
  misc_feature (1413)..(1413): n is a, c, g, or t
  misc_feature (1419)..(1420): n is a, c, g, or t
  misc_feature (1487)..(1487): n is a, c, g, or t
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccantctggnntcacctcaaccccgggttaacacaacccggagtcaccacagcctgcggtcacacaacccaggtcatn

SEQ ID NO: 290020 - DNA, 1180 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccaccccccgctcattaaacagcctcccccagcaaaaaaaaaaagaatgagactatgcatatc

SEQ ID NO: 290021 - DNA, 1969 bp, Homo sapiens
gtgaacactaggggcttgggcagtccgggatggcttcctggaggtggtgactcgtttgtgagatcttggtcttgtcttccctttatgccttctctgggctccctattacaatttcaggtctccaggccttggcaccctgggctggagcggcttcctctccatccctcatgcctggtcacttggagacaggctccagcttccttgtgtctgtgcctgtccacagtgggcctcagcctcctggaagagactgggtgcgctatggggtggccccctcagggctggttagaccctggcgctgggagtgcagggtgaggggcagtctcgagggctccagcccagcccgcccagggaggtcccagcagcagccccgagttctgagccatcttcctcactctcctcttggcctccacaggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290022 - DNA, 2038 bp, Homo sapiens
aaaaaaaaaaaaaaaattagccgggcgtggttggtgacgcgcgcctgtagtcccagctactctggaggctgaagcgggaagatcgcttgagtccaggaggtcgaggctgcagtgagttgtgattgtgccgttgcactccagcctggacaacagagcaagaccctgtttgacaaaataaaaaagaaacaaccaagattcgttggggtcgaatcgggatcgcggctgaaatggtttcggccgccttccttgtagccgagaacgcttctgtatgctcatctatacctgttagttgactggggctctgtgatgtaattcctgtgagcctcagttcccttaaaatgggagtgacggcttcaacatcatgccaaaggcgaccagaacacgttagctggccccattttgcaggtgcaccccgctgtgaccgttgttcttgtgtatccttggacgacaccaaacagccaggcggagctctggaaaataggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290023 - DNA, 1443 bp, Homo sapiens
agaaaggaatatgctagtcgaggctggctgaatcggacgaggcacaacggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290024 - DNA, 1853 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaagacccgtacttcatgaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290025 - DNA, 1397 bp, Homo sapiens
tacccagcaagtgttctttacagaaggcggggacagcctgtgtgcctggcctccagacagaagcctgcagggcagaggtcccggggcaggtgcaccgggtgggcgagggtggctagagcggcaggctcccccggggtcccgctctcgttcagtgggtggcattagcctgccccaggttcctcagcttcggagaggacaagcagccgggacctgagagctttctgtgttgcagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290026 - DNA, 821 bp, Homo sapiens
caatgctgctggtacgctccggaagtatgggataacacgaagtcgtggaggtggcgaaacgaggaggagataacgcggccttgggctctggtgtctcccagtctgctaaagccctaaggccatcaccatggacttccactacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290027 - DNA, 2075 bp, Homo sapiens
cagatagcccaccaggggtggggagggtgagcagggacagggcgcccccactgacttgggaccctcctcctccaggcccacacctcagcacccaggacatctgggccccccgcccccagcgctgtctagtttggttgcctggccgtcactcccagcctggttcccactcctgtgtcttctggggatggccctcaaggacggcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaagagcctctgcccctcccgagacacccgctacctggtgttagcggtggaccgccctgcgggggcctggcgcggctccgggctggccttgaccctgcagccccgcggagaggactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggaggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggcccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggc

SEQ ID NO: 290028 - DNA, 1005 bp, Homo sapiens
aacataggctaggtacgaggccgggtgtgcacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagcccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgcagcgctgccctactgtgtcagtgtgtgtgggagtgccaggcacagcaccatcccccagtttgggccgactggggagggcctggggcccgccaggagacacctgtgggaggcctgagagatggctgtaccttggagatggcctggtggaggacagaccccaccagccagctaggaggggatctggggtcctgttctggggagggaagagcagatcctgccccgagggtccggacgcgccccagctcgcgccccttcccatatttattcggaccccaagcatcgccccaataaagaccagcaagcaaccggc

SEQ ID NO: 290029 - DNA, 385 bp, Homo sapiens
tacgcaggggaagaagcaccagaccaacctgtgagtacctcatgtccctttgatgcctggtgctccagcagccgttggctcaagtctctgtgagcctcgcgggccactgctccacagccggggagccagcctggcctgagcctccctgggcgcttgagtacggttcctggggagcattagagaacagaggcatggatggctgaggcgggcagatcacttgaggtcaggagttcgagaccagcctggccaacattgtgaaactccatctctactaaaaatacaaaaattaggccaggcatggtggcacacgtctgtaatcacagctactatggaggctgaggcaggagaatcttgaatctgggaggcagagattgcagtgaaccaa

SEQ ID NO: 290030 - DNA, 812 bp, Homo sapiens
gggcctggctgcgggaccctggggggcagcgcctggtggtcctacacctggaggaaggtatgtggggcccagccccaagcttggcaccgccgtcttccttcaggtgggccgggtcctcctagggaagatcaggggctggcagagcccccaccctgggcagggaggctgtggtcttgttcctaggactgggttgcgggtccgtggcctggaaggtgggcaccacactctgtcctgtccccgaagcccagctcttagacttgcccctgcctcggtgccagggagagagctgctgccttctccccacccctgaagacgacgcagggctcggggccagtggaacccttcttcccacagccccagcctgttctcagggccgctggcctaagatactccctgcggggaaggggcttcatcgggcaccccaacccagagaccccagggcggcagccccacccacagcctcagacgcagcccctgcctgcccctgccgtcaccgctccctggctgcaggaaggcagctaagaggggcacccttgtcccccgcttgaggtcccctgcacagtggccagagcggcagggacagatcccaaagattcccggggggtgtggccttcaatggctcaggcgtcccctgctgtcccggctgcagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccaggtaccagggagttgcatggg

SEQ ID NO: 290031 - DNA, 335 bp, Homo sapiens
tggcgaattcggcacgagggagaagccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290032 - DNA, 942 bp, Homo sapiens
  misc_feature (942)..(942): n is a, c, g, or t
ataggctaggtacgaggctgtgtgttgggcgaaacgaggaggagataacgcggcttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgccccaggtgcgctgtcattccaaaggtcgcgccagcgcccgggaccacatagacgacagcaaccacggggagtacatctagn

SEQ ID NO: 290033 - DNA, 788 bp, Homo sapiens
gaaaaggatggtcatggatccagagatctcacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgcgagcagagagatcgacaagggcggagcgcgcgtcctgacacactggaccgggaaccagcgtcttcctccgtcctaaggaaagcccgcccaccggccccggagggcgcaagagctgcg

SEQ ID NO: 290034 - DNA, 1647 bp, Homo sapiens
caatgctgctggtacgctccggaagtatgggataacacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290035 - DNA, 1877 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctcttttgtactgccccccgctcattaaacagcctcccccagccctgagtgcactga

SEQ ID NO: 290036 - DNA, 1937 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgcagcgctgccctactgtgtcagtgtgtgtgggagtgccaggcacagcaccatcccccagtttgggccgactggggagggcctggggcccgccaggagacacctgtgggaggcctgagagatggctgtaccttggagatggcctggtggaggacagaccccaccagccagctaggaggggatctggggtcctgttctggggagggaagagcagatcctgccccgagggtccggacgcgccccagctcgcgccccttcccatatttattcggaccccaagcatcgccccaataaagaccagcaagcaaccggc

SEQ ID NO: 290037 - DNA, 1390 bp, Homo sapiens
  misc_feature (1166)..(1166): n is a, c, g, or t
  misc_feature (1172)..(1172): n is a, c, g, or t
  misc_feature (1184)..(1184): n is a, c, g, or t
  misc_feature (1186)..(1186): n is a, c, g, or t
  misc_feature (1193)..(1193): n is a, c, g, or t
  misc_feature (1202)..(1203): n is a, c, g, or t
  misc_feature (1209)..(1209): n is a, c, g, or t
  misc_feature (1211)..(1211): n is a, c, g, or t
  misc_feature (1213)..(1213): n is a, c, g, or t
  misc_feature (1226)..(1226): n is a, c, g, or t
  misc_feature (1236)..(1236): n is a, c, g, or t
  misc_feature (1239)..(1239): n is a, c, g, or t
  misc_feature (1242)..(1242): n is a, c, g, or t
  misc_feature (1252)..(1252): n is a, c, g, or t
  misc_feature (1265)..(1265): n is a, c, g, or t
  misc_feature (1269)..(1269): n is a, c, g, or t
  misc_feature (1275)..(1275): n is a, c, g, or t
  misc_feature (1282)..(1283): n is a, c, g, or t
  misc_feature (1297)..(1297): n is a, c, g, or t
  misc_feature (1301)..(1303): n is a, c, g, or t
  misc_feature (1307)..(1307): n is a, c, g, or t
  misc_feature (1312)..(1312): n is a, c, g, or t
  misc_feature (1327)..(1327): n is a, c, g, or t
  misc_feature (1384)..(1384): n is a, c, g, or t
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccactcttccttaatnttttcnatttccctccanantcttctnttcaccatnnccccanangncttcccctcaggnccccggacanccnacnacccccaacncaaggtcaccccngccnatatcnacccttnnttgggtcatcccantctnnntcancccantctgcgtcatcccancctgtgtcacaccactctggtcacccagtctgaatcactcaccccgggttacacacncggatc

SEQ ID NO: 290038 - DNA, 1621 bp, Homo sapiens
ataggctaggtacgaggctgtgtgttgggcgaaacgaggaggagataacgcggcttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290039 - DNA, 1696 bp, Homo sapiens
caatgctgctggtacgctccggaagtatgggataacacgaagtcgtggaggtggcgaaacgaggaggagataacgcggccttgggctctgagatggggttttaccaggttggccaggctgtcccctgatctttaccttagtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290040 - DNA, 2017 bp, Homo sapiens
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccaggtgagatcagggacttgggcgtggggggcggccaaaggcacccaagaggcggctctgccacccggccgtgtccctgcagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290041 - DNA, 1287 bp, Homo sapiens
gtgtgtgtgtgtgtgtgtatatatatatttttttttttttagatggagtcttgctctgttgcccaggctggagtgcagtggcgccatctcggctcactgcaagccccgcctcccgggttcattgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactga

SEQ ID NO: 290042 - DNA, 995 bp, Homo sapiens
  misc_feature (948)..(948): n is a, c, g, or t
gaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccgggacccgggcgcctgggcaattaacccttggcttccaattgggncccggcccgaaggccccccttaccgggaggaaccccaattttggccc

SEQ ID NO: 290043 - DNA, 1370 bp, Homo sapiens
atggatttgttgcagggtctgcagtactgagaacagcgtagaaccagtggcgatgggaggaaggggaccggtagagcggggctgggtaagcctccatccagccgggctgagccctggtctccgcagagcctctgcccctcccgagacacccgctacctggtgttagcggtggaccgccctgcgggggcctggcgcggctccgggctggccttgaccctgcagccccgcggagaggactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggaggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggcccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggc

SEQ ID NO: 290044 - DNA, 221 bp, Homo sapiens
ggtcccagcagcagccccgagttctgagccatcttcctcactctcctcttggcctccacaggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaac

SEQ ID NO: 290045 - DNA, 1856 bp, Homo sapiens
  misc_feature (18)..(18): n is a, c, g, or t
  misc_feature (20)..(20): n is a, c, g, or t
  misc_feature (24)..(24): n is a, c, g, or t
  misc_feature (26)..(27): n is a, c, g, or t
tcggctaggtacgaggcngngtgntnngtacggctcctgggcctctcccgggtcaagggtctccaggtcccgctgcctcggcgtggatctcggacccagagactcggggagacccgggcggtccgtgggggatgtggaggggtagtgacctgcgcccccggccggtgtcactcacaggcctcactctggttgtagtagccgctcagggtccgcaggttcactcggtaaaactgtgctttggccttggcggtccctgtctcctcttcccaatattccggcccctcctgctccatccacggcgcccgcggctccatcctgggactcgtggcgtcgctgtcgagccgcacgcactgcgtgtcgtccacgtcgcccacggagaggaagcggggatccgcgcggccgggccgggacatggtggtgtggaaatacctcaaggagtggaagcctgggagcaaggagggggctgagaccctcccgaccctcctcccggcaccgcaaccgggttcctgcgcccccgccgggcaggcccctagctactccccacagacgccgtttccctcccgaccccgcactcacctgcccaggtctgggtcaggaccagggcccccgagagcagcagaagcagggttcggggcgccatgacaccatcctcggcgactgggaagaatcggagtcccggtgggtgcgtgggaactttagaaccgggaccgcggctacattgattggcttctctagaaacccgacactcaatgggagtgagaactggggcagcccggtgagtacccaggaagaaggacccgacacaggttgggagagggagaagagaaaccctgcaaagatggggaatgcccagcgctgggcctccccaatccatacaccgcctttggggcctgagatcctgagagccacgcctgaggccctgggacttcgccctgaccccgctacttctgtgccaagcgctctgtctcaatgtttccctgagtcttggcccaggagctgtctgagaaaccagggagaaaccctcggaatgggccccgtccctctctcttcactttgcatcacggaatccccgtcccagaactggactccctgcctcctactccttacctgtccccgtggactcttctagaagaaaaatcaccccagggagcttgttgccagagagtgagcttgccctgggaatggaggtgtagagacagggttttttgttgttgttgtttgtttgttttttaaatctggaaaagttgtgcctgagtgcatgagatagaatagagaccagtttgctttttgtttattaactacagtgggtagcagaatcttggtaactcctaatgatcaggaatctaatcggccaaaaatgtgactttggtcccttgacatataaatgtgtctaaaagcattacaacaggaatcacaaagctcctaagtttcactttcccagacaatgtatctgtgactcccgcttgtagtattttaaatttaccttcattccatagccctgagtttctgtgtgagtccaggacatctcctaatacaaggtagccactgtgttactatatgttgtaaccaggagccagtacggactttattcatctcacagtggcaagcactcaatgcagtcacaatgcccctcaccagtgctcatgcactgcctgtttttaggaagtatccacttctaagtgttgtgtatattttatatgaacacttagtattttttaaacctgattaacataaaaaaattagtttttaggcagacccacataaggtattaaaggccaactgcaaagatcaccctgcaaggctctgtagattgatgtattaaaatatataaaacaatgtgtttaaacctgagttct

SEQ ID NO: 290046 - DNA, 2048 bp, Homo sapiens
caaggagcacaggtcctcgttcaggacgatgtaatccttgccatcgtaagcaagctggtgatacccgcggagtaggcgcccgtccgaccccacgtcgcagacagacatcctctagatgggtgtgagaccctggccccgcccccgcggccagccccgcccaccgagccccgccctcgccaggaccaacctgcggggattttggctgaaaatgaaaccgggtaacggctcctgggcctctcccgggtcaagggtctccaggtcccgctgcctcggcgtggatctcggacccagagactcggggagacccgggcggtccgtgggggatgtggaggggtagtgacctgcgcccccggccggtgtcactcacaggcctcactctggttgtagtagccgctcagggtccgcaggttcactcggtaaaactgtgctttggccttggcggtccctgtctcctcttcccaatattccggcccctcctgctccatccacggcgcccgcggctccatcctgggactcgtggcgtcgctgtcgagccgcacgcactgcgtgtcgtccacgtcgcccacggagaggaagcggggatccgcgcggccgggccgggacatggtggtgtggaaatacctcaaggagtggaagcctgggagcaaggagggggctgagaccctcccgaccctcctcccggcaccgcaaccgggttcctgcgcccccgccgggcaggcccctagctactccccacagacgccgtttccctcccgaccccgcactcacctgcccaggtctgggtcaggaccagggcccccgagagcagcagaagcagggttcggggcgccatgacaccatcctcggcgactgggaagaatcggagtcccggtgggtgcgtgggaactttagaaccgggaccgcggctacattgattggcttctctagaaacccgacactcaatgggagtgagaactggggcagcccggtgagtacccaggaagaaggacccgacacaggttgggagagggagaagagaaaccctgcaaagatggggaatgcccagcgctgggcctccccaatccatacaccgcctttggggcctgagatcctgagagccacgcctgaggccctgggacttcgccctgaccccgctacttctgtgccaagcgctctgtctcaatgtttccctgagtcttggcccaggagctgtctgagaaaccagggagaaaccctcggaatgggccccgtccctctctcttcactttgcatcacggaatccccgtcccagaactggactccctgcctcctactccttacctgtccccgtggactcttctagaagaaaaatcaccccagggagcttgttgccagagagtgagcttgccctgggaatggaggtgtagagacagggttttttgttgttgttgtttgtttgttttttaaatctggaaaagttgtgcctgagtgcatgagatagaatagagaccagtttgctttttgtttattaactacagtgggtagcagaatcttggtaactcctaatgatcaggaatctaatcggccaaaaatgtgactttggtcccttgacatataaatgtgtctaaaagcattacaacaggaatcacaaagctcctaagtttcactttcccagacaatgtatctgtgactcccgcttgtagtattttaaatttaccttcattccatagccctgagtttctgtgtgagtccaggacatctcctaatacaaggtagccactgtgttactatatgttgtaaccaggagccagtacggactttattcatctcacagtggcaagcactcaatgcagtcacaatgcccctcaccagtgctcatgcactgcctgtttttaggaagtatccacttctaagtgttgtgtatattttatatgaacacttagtattttttaaacctgattaacataaaaaaattagtttttaggcagacccacataaggtattaaaggccaactgcaaagatcaccctgcaaggctctgtagattgatgtattaaaatatataaaacaatgtgtttaaacctgagttct

SEQ ID NO: 290047 - DNA, 745 bp, Homo sapiens
acttgcatcattgtctgacagctctctcatctttcattgactcccaactctcagcaacatggaaatgcccaaattcccctgacatatggtagaggaagaaataaagagtttgagggaaatgagcatgaaggaatggatatattagggaggaatggcctacaggggccatgcaggggctgcatggaggaattggtcagtacacacagaagtggatggcactgggccaggcacagtggctcacacctgtactcccagcactttgggaagctgaggtgggtggatcgcctgagcccaggagttcgagaccagtcaagacaacatgacaaaactccacgtctactaaaaatacaaaaactagctgggcatggtggcatgtgcctgcaatcccagctacttgggaggctgaggcaggagaatcgcttgaggtggaggttgcagtgagccaagatagtgcccctacactccagcctgggtgacagagtgagactttgtctcaaataaataaataaataagaagtggactgctgtggtgtgagaatgcacctgacagacctccaattatggagagcttacacagccaagggccccaactgctgctctctgaaactcatcctgcttttgtgctgaggccacacttcccacaggctgctccagccagtgaccaagcacagcatggacactaagacaggcccattctgggagacgtgggactcctctgatggccaactttgacttggggactccc

SEQ ID NO: 290048 - DNA, 3332 bp, Homo sapiens
ggcacgaggtcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctcctactatgtagaaggaggatgggctgtaggggccctgaggaggtgagcaaccagcctgggagtcagggaggactcttcagaggaagccaagtccaggctgagccccaggaggagtaggagttgggcaggggaagagtcgggaggagcttccctggcccctccgattagaggatctaatgggggctccaactgtggcctcagcaccatctcggattaggggctcctgagtgtgtagggaaggacacgggagaggcttagagctctttggaggaggattctgcctttcctccagtgccatgagcctgacacatgaaggtcttgggttctatgacttgaccacatcctgagagcaaggtggggccctcgactgtcttgtattggccccaagcctttcttgctgtgaacagcttcattctcagtcccctttcctggctcaaaaatcgagcctagcaaaagaagaggcacgggaaggaaacgcccctccctcctcctgcaggcagccactcagcctgtgccttcagcttggtgccctggtgatggttgctatggagatctaaagatagagcaggagtcaggagacctgggtccctctcccagcttgtcccactgagcggctgccgatcacggtccacccaccccaggaacctggcacccctatcccaggaacccagtgcccctgggcagcgcactgcagttaatgaattctgccttcaacagcctgggctctagcgtgctgcaccagcttgggctagctacaggcagtcccagaattggaatattaagccatggaatcttagagttagacttttatagtcatagaaatgtactcttcaccatatcaaagctgaaagttcaggactctaagaaacatacagtgtgacagacttatcgtatacacgggaaactgaagcccagtgagactaaatgacttgcccagggtaaaacagtccatggcagagccagcactagaagcctcctagcttcaacctcatgtgccaattctgcatcagtgattttcgaactgcgctctacaggaagcaagggttctttgcatagcagcagtgaaaggacagctccagatggatccccagtacccccttcaaccagagcagctgcatttttatcccattcatatattggggttttgaattatttttatttgtacaaaaggattttcctagccactaaaaaaaatggcaacaaatctctctgctgtgtcacatttaataaataattgtgacacatagctggggggtggtgctggaggtttcagaccgcctcacaggcagagttccagggtcagagagcatggagtactgtgtgtgaccttcttccagaagcacgggcacaggagcatgttaaaggccctgaaaagaccagtggcaaagaaactcctttcattttgtttaatccagagtttttcaagcttatttaactatagaacacttttctgtgggtttcgtagcctctttctagcacagtatagtgagtgggaaaggccctgactgagagtcaaagattctgagcaggaaccatgatctcttcctgcctagtatgtgacttgagcaagacacttttcctctccccaggcctctgaggtctgcgagttttcctccaccctttcctctccctcagtttgcacatcctattgactcagctccaaatagcgggggcctgtcaggagcctgactctgttcagacaccagggaaacaacagcacaccaggcagatgcagttatgtccatcggggaacttacagcctagcaaggaaggcagcaattcaacctgtaagtctaaaagtgatgggtgtcatgaaaaggtaagtgcagggtgctgggagagtggttggcaggggctttagcctagtctagggagagcccaggggcacaccactgccagcggggatagaggcttcaaaagctttgaagtcactcatattaagagtgttgccggacacggtggctcatgcctgtaatcccagcactttgggaggctgcggcaggcagattgcctgagcccagaagttcgaggccagcctggccaacatgacaaaaccctgtctctacaaaaaaaa

SEQ ID NO: 290049 - DNA, 834 bp, Homo sapiens
ggcacgaggtcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacgagggatagtagatgacttagaaattcagagagcctatacgcccatcagccctgccaacgcagaaggatactttgaagtgttaattaagatgaagaaactgaagctcaaaaagatgacatcatttgtctcaaggcctcttgggtaatatgatccaaatggaaggacaaaagttcagtgtcagttctgtttaacaagtatgtattaaacatttactctgtgccaggc

SEQ ID NO: 290050 - DNA, 973 bp, Homo sapiens
ggcacgaggtcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtagatgacttagaaattcagagagcctatacgcccatcagccctgccaacgcagaaggatactttgaagtgttaattaagatgaagaaactgaagctcaaaaagatgacatcatttgtctcaaggcctcttgggtaatatgatccaaatggaaggacaaaagttcagtgtcagttctgtttaacaatgctaccagatggggctgatgtcccggtatgttgagtcctggagagtaggagacacagctttctggcgaggacctttcggagatttcttctataaaccaaaccagatggaatcttgctctgttgcccaggctggagtgcagtggcatgatctcgactcactgcaacctctgcctcccaggctcaagcaattcttctgcctcagcctcccaagtagctgggactacaggcgtgcaccaccacgcttggctaatttttgtatttttagtagagacggagttttgccacgttggtctcgaactcctgaccttaagtgatccg

SEQ ID NO: 290051 - DNA, 2577 bp, Homo sapiens
  misc_feature (2479)..(2479): n is a, c, g, or t
  misc_feature (2485)..(2485): n is a, c, g, or t
  misc_feature (2496)..(2497): n is a, c, g, or t
ggcacgaggtcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagggatagtagatgacttagaaattcagagagcctatacgcccatcagccctgccaacgcagaaggatactttgaagtgttaattaagtgctaccagatggggctgatgtcccggtatgttgagtcctggagagtaggagacacagctttctggcgaggacctttcggagatttcttctataaaccaaaccagtatggtgagctcctcttgctggctgcgggcacgggcctggcccccatggtgcctatcctgcagagcatcacagacaatgagaatgacgagacttttgtcactctggtcggttgcttcaagacctttgagagcatctacctgaaaaccttcctccaagagcaggcccgtttctggaatgtccgtaccttctttgtactcagccaggagagctcctcagagcagcttccctggagttaccaagagaaaacccactttggccacctgggccaggacctaattaaagagctggtcagctgctgtcggagaaagccattcgcactggtctgtggctcggctgagttcaccaaagacatagccaggtgcttactgtgcgcaggcctcactgaggactcctatttcctcttctagccctggcctctcttccaaagcctaggccatgagcctgctactgggacccaggaaggagcacagactggaatcagaagacacggagtccaggcctggtcctgctgctcatttgccaggtgaccttgggcaagtgtctttactgctcagaacctctacttctcatctgccccatgaggttaatcactcctcctggcctcctactatgtagaaggaggatgggctgtaggggccctgaggaggtgagcaaccagcctgggagtcagggaggactcttcagaggaagccaagtccaggctgagccccaggaggagtaggagttgggcaggggaagagtcgggaggagcttccctggcccctccgattagaggatctaatgggggctccaactgtggcctcagcaccatctcggattaggggctcctgagtgtgtagggaaggacacgggagaggcttagagctctttggaggaggattctgcctttcctccagtgccatgagcctgacacatgaaggtcttgggttctatgacttgaccacatcctgagagcaaggtggggccctcgactgtcttgtattggccccaagcctttcttgctgtgaacagcttcattctcagtcccctttcctggctcaaaaatcgagcctagcaaaagaagaggcacgggaaggaaacgcccctccctcctcctgcaggcagccactcagcctgtgccttcagcttggtgccctggtgatggttgctatggagatctaaagatagagcaggagtcaggagacctgggtccctctcccagcttgtcccactgagcggctgccgatcacggtccacccaccccaggaacctggcacccctatcccaggaacccagtgcccctgggcagcgcactgcagttaatgaattctgccttcaacagcctgggctctagcgtgctgcaccagcttgggctagctacaggcagtcccagaattggaatattaagccatggaatcttagagttagacttttatagtcatagaaatgtactcttcaccatatcaaagctgaaagttcaggactctaagaaacatacagtgtgacagacttatcgtatacacgggaaactgaagcccagtgagactaaatgacttgcccagggtaaaacagtccatggcagagccagcactagaagcctcctagcttcaacctcatgtgccaattctgcatcagtgattttcgaactgcgctctacaggaagcaagggttctttgcatagcagcagtgaaaggacagctccagatggatccccagtacccccttcaaccagagcagctgcatttttatcccattcatatattggggttttgaattatttttatttgtacaaaaggattttcctagccactaaaaaaaatggcaacaaatctctctgctgtgtccnttatantatgggcctanngggggggggggggtaaaccgcccagggagccggcaaactggacagggggcctcaaacgggaattaggcgaaacgggacct

SEQ ID NO: 290052 - DNA, 977 bp, Homo sapiens
ggcacgaggtcctcacgtgaggtgaagcgcaggcgagtagggccagacatggtggctcatgcctgtaatctcagcactttgggagactgagatgagaagatcacttgaggccaggagttcgagaccagactggcaacatagtgagaccctgtctctacaaaatgctggccaaggagcagggcctgcgcccgtggtctcatagagcctggcctgttctggaagagcacccagttgttccttctaggctgcccaagccccactgatgatggctgagagggaagaggacgacgacactgaggaagcctggatgcagctacggcccacagaacccttgccttcccagtgctgcggcagtggctgctcaccctgtgtgtttgacctctatcaccgagatctggcaaggtgggaggcagcccaagccagcaaggacaggagcctgctgcgtgggccagagtcacagagctgcccctccaagctgaacccagagaccttcgtggccttctgcatcattgccatggacaggctcactaaggacacctaccgtgtccggtttgctctacccgggaacagccagcttggcctgcggcccggccagcacctcatcctacggctggtctcaaactcctgacctcaagtgatcagcccacctcggcctcccaaagtgtggggattacagacatgagccaccgtgcccagccttaaaagggtttgctgaatgactggctgactgactgcacacttctgtttctcagagggatagtagatgacttagaaattcagagagcctatacgcccatcagccctgccaacgcagaaggatactttgaagtgttaattaagatgaagaaactgaagctcaaaaagatgacatcatttgtctcaaggcctcttgggtaatatgatccaaatggaaggacaaaagttcagtgtcagttctgtttaacaagtatgtattaaacatttactctgtgccaggc

SEQ ID NO: 290053 - DNA, 482 bp, Homo sapiens
ttcatgtgactcagcctcccaggtagctgagactacaggcgtgagccaccacacccagctaaatttttgtacttttagtagtgacgggtttcactatgttgtccaggctggtctcaaactcctgacctcaagtgatcagcccacctcggcctcccaaagtgtggggattacagacatgagccaccgtgcccagccttaaaagggtttgctgaatgactggctgactgactgcacacttctgtttctcagagggatagtagatgacttagaaattcagagagcctatacgcccatcagccctgccaacgcagaaggatactttgaagtgttaattaaggtgagttgacccttgaggatgctccaagatgccgtggagaagctatgggtctaagaatggagagctaaagggaaaatgtgggaaggaaactcagtgctgggaacaacatggacaaaggcaattggggaagtaagtcctttgtcct

SEQ ID NO: 290054 - DNA, 886 bp, Homo sapiens
atcgatagggctgcacagaggtggcacagttgtgccagaggtagcagggacaggagggctggcaagggagggtccagggctaggggattcggagtggcttcaggcggaccacgtggctaccttttttccagggccagactttggcagcgtgtaaggtctgaggacaggggcaccggaggccgaggatgagaggccagtgcctgtttccaggcagccagggcctcagaaactccggccggagcactcacccgtcggtggaggccgttaccagggccaccttatttgcgagcgggtcccggcgggtcatcccggagctggccatccgcaccgaattccaagcccgggcacagaggcctagcagccccgccttgtgcatggatcagaccagcaagtgccacttcggataaaccctttggactcctaactccaatcaggtgtctgctttgttgaggactcacagacacagtctcctttcttcaagatctttacaatgcaagacctcactaacacacagggatggtctcccagagggtctgtgctgttccttcactcagaacatcaagatgcactgaagtaaggatcctctattctacagttcctgctagctgagctattccatgggggcttcagcaggaaattccaaggttggctttgacaagctaaggccggctggtggagcacatcgagttctggaggttcatgtgtgttttcatgaagatctgtctgcccgtagcagataaagagttgttgccccactcctcctggggtcttctattttcctgggaggaatttctggattaactgaacacacacacacacacaatcttcaggccaataccctcgatgaacatcaatgcaaaaatcctcaacaaaacgaaagcggccg

SEQ ID NO: 290055 - DNA, 2478 bp, Homo sapiens
gcgcccctccaccatctaccttccgcctgactggggcttgcctttccgggctggcgggtgccacttcggataaaccctttggactcctaactccaatcaggtgtctgctttgttgaggactcacagacacagtctcctttcttcaagatctttacaatgcaagacctcactaacacacagggatggtctcccagagggtctgtgctgttccttcactcagaacatcaagatgcactgaagtaaggatcctctattctacagttcctgctagctgagctattccatgggggcttcagcaggaaattccaaggttggctttgacaagctaaggccggctggtggagcacatcgagttctggaggttcatgtgtgttttcatgaagatctgtctgcccgtagcagataaagagttgttgccccactcctcctggggtcttctattttcctgggaggaatttctggattaactgaacacacacacacacacacacacccttttgaagcatcaacagtaattctgagttcttagggacaatgcagattaaatccacaataagaaagacaactatggccaggtgtggtggctcacgcctgtaatcccagaactttgggaggctgaggcggatggatcacctgaggtcaggagttagagaccaacctgaccaacatggagaaaccccgtttctactaaaaatgcaaaattagccgggcatggtggcaggcgcctgtaatcccaaatactcgggaggctgaggcaggagaatcacttaaacccgggaggcagaggttgcagtgagccaagatcgcgccattgcactccagcctgggcaagaagagcaaaactccatctcaaaaaaaaaaaaaaagagtactattgatccagaggtgaccagactagcctcactggagataataggtgacattattatgcaaagtggtttcagttcccttgtcttgtttttggaatagtataagaggcctacaatacgaataaataaggcccatcacaagcctcaccaaaggacaaaactaatccacttctgaagaaggctctttgttgggccagatcaaatccttggacagaactgtactcttaatctctgtagtgaaagtggggggtagtttaagaatttattaaccttctaccttgagcaatccctcagaagtaagaggtgtcaggcctctgagccgaagctcagccattgtaacccctgtgacctgcacatatatgtccagatggcctgcaggagccaagaagtctggggcagctgaaaaaccacacaagaagtaaaacagccagttcctgccttaactgattaaccaacattacaacattccaccattgtgacctgtccctgtcctaccttaactgatcaatcgaccttgtgacagtcttcttctggacaatgggtcttatcatctccccaccatgtaccttgtgaccccctcctctgctaacaatagataaccactttttactgtaattttccattacctacccaactcctataaagcaaccccttccccatctcccttcactgactctgttttcagactcagcccacttgcactcaagtgaataaacagccttgttgctcacacaaagcctgttggtggtctcttcacacagatgtgcttgacaaaagggaagggtggatttgtccttctggttacatatgttctgctcactcattttgaatttaattaaacaaggattgcccttaccttttcatactttgtaagaaaccataaatacttatgcaccatgatttttttaaagaaacactttttattttgaagtaattatagtctcataggaagttgcaaaagtagtacatagagtccctgagtactcttcccccagtggtgacaactgtagtataatatcaattctgggaaattgacattggtacaataccaaatatactatgcctttttctctaaggcatgatgttgcagtagcatccttgtacatgtagctaggagaacttgtactaagcccagataaatagttgaagtacaagggcaaggagtgtgtctttgatattttaatagaaatcacctattgccctctagaaaagctgtacccttttccagtggcagagaaccttcctgaaaggcagtcctgtgtaatggtgtccatttcatcacacccttaaaacactcagctttaacaaacatgcagatttttgctgatgtgggagaaaatattaattattaatgatattaaggtgattatcttttcgtatgtttatagatatttgtatttctttttaaatgaactgctcatgacctttgtctacttttatttgggtttacttctttctcatttattcctataaactctttataaaaggaaattaaccatttgattgtcatatgttgtgaatatttttaccattttgacttttgaatttatgtctttttaatgaattgtagaagtttaaaatctttatggaataaatttatttagttttt

SEQ ID NO: 290056 - DNA, 2812 bp, Homo sapiens
atcgatagggctgcacagaggtggcacagttgtgccagaggtagcagggacaggagggctggcaagggagggtccagggctaggggattcggagtggcttcaggcggaccacgtggctaccttttttccagggccagactttggcagcgtgtaaggtctgaggacaggggcaccggaggccgaggatgagaggccagtgcctgtttccaggcagccagggcctcagaaactccggccggagcactcacccgtcggtggaggccgttaccagggccaccttatttgcgagcgggtcccggcgggtcatcccggagctggccatccgcaccgaattccaagcccgggcacagaggcctagcagccccgccttgtgcatggatcagaccagcaagtgccacttcggataaaccctttggactcctaactccaatcaggtgtctgctttgttgaggactcacagacacagtctcctttcttcaagatctttacaatgcaagacctcactaacacacagggatggtctcccagagggtctgtgctgttccttcactcagaacatcaagatgcactgaagtaaggatcctctattctacagttcctgctagctgagctattccatgggggcttcagcaggaaattccaaggttggctttgacaagctaaggccggctggtggagcacatcgagttctggaggttcatgtgtgttttcatgaagatctgtctgcccgtagcagataaagagttgttgccccactcctcctggggtcttctattttcctgggaggaatttctggattaactgaacacacacacacacacacacacccttttgaagcatcaacagtaattctgagttcttagggacaatgcagattaaatccacaataagaaagacaactatggccaggtgtggtggctcacgcctgtaatcccagaactttgggaggctgaggcggatggatcacctgaggtcaggagttagagaccaacctgaccaacatggagaaaccccgtttctactaaaaatgcaaaattagccgggcatggtggcaggcgcctgtaatcccaaatactcgggaggctgaggcaggagaatcacttaaacccgggaggcagaggttgcagtgagccaagatcgcgccattgcactccagcctgggcaagaagagcaaaactccatctcaaaaaaaaaaaaaaagagtactattgatccagaggtgaccagactagcctcactggagataataggtgacattattatgcaaagtggtttcagttcccttgtcttgtttttggaatagtataagaggcctacaatacgaataaataaggcccatcacaagcctcaccaaaggacaaaactaatccacttctgaagaaggctctttgttgggccagatcaaatccttggacagaactgtactcttaatctctgtagtgaaagtggggggtagtttaagaatttattaaccttctaccttgagcaatccctcagaagtaagaggtgtcaggcctctgagccgaagctcagccattgtaacccctgtgacctgcacatatatgtccagatggcctgcaggagccaagaagtctggggcagctgaaaaaccacacaagaagtaaaacagccagttcctgccttaactgattaaccaacattacaacattccaccattgtgacctgtccctgtcctaccttaactgatcaatcgaccttgtgacagtcttcttctggacaatgggtcttatcatctccccaccatgtaccttgtgaccccctcctctgctaacaatagataaccactttttactgtaattttccattacctacccaactcctataaagcaaccccttccccatctcccttcactgactctgttttcagactcagcccacttgcactcaagtgaataaacagccttgttgctcacacaaagcctgttggtggtctcttcacacagatgtgcttgacaaaagggaagggtggatttgtccttctggttacatatgttctgctcactcattttgaatttaattaaacaaggattgcccttaccttttcatactttgtaagaaaccataaatacttatgcaccatgatttttttaaagaaacactttttattttgaagtaattatagtctcataggaagttgcaaaagtagtacatagagtccctgagtactcttcccccagtggtgacaactgtagtataatatcaattctgggaaattgacattggtacaataccaaatatactatgcctttttctctaaggcatgatgttgcagtagcatccttgtacatgtagctaggagaacttgtactaagcccagataaatagttgaagtacaagggcaaggagtgtgtctttgatattttaatagaaatcacctattgccctctagaaaagctgtacccttttccagtggcagagaaccttcctgaaaggcagtcctgtgtaatggtgtccatttcatcacacccttaaaacactcagctttaacaaacatgcagatttttgctgatgtgggagaaaatattaattattaatgatattaaggtgattatcttttcgtatgtttatagatatttgtatttctttttaaatgaactgctcatgacctttgtctacttttatttgggtttacttctttctcatttattcctataaactctttataaaaggaaattaaccatttgattgtcatatgttgtgaatatttttaccattttgacttttgaatttatgtctttttaatgaattgtagaagtttaaaatctttatggaataaatttatttagttttt

SEQ ID NO: 290057 - DNA, 2764 bp, Homo sapiens
tgacgaccacatgggccccgtcctgggccaaacgccgggcgatggcgaagccgatcctgtgagcagaaagagacaaagactgctaaggcctgtgcaggggaagaggtcgacagtatgagctctgaagttaagactgcccgggtttgaattctggctctttctctatataacccctacgtgtgcctactatgtgtaaaacaggcttaatggcatggccatttttggcattcctttacttgtttttattatgacctggaccacagcctcagttcccaagaactgacatcactttctacagttcccaccatgggtgacaggcttcatcccctcttgggactgagaggtgccacttcggataaaccctttggactcctaactccaatcaggtgtctgctttgttgaggactcacagacacagtctcctttcttcaagatctttacaatgcaagacctcactaacacacagggatggtctcccagagggtctgtgctgttccttcactcagaacatcaagatgcactgaagtaaggatcctctattctacagttcctgctagctgagctattccatgggggcttcagcaggaaattccaaggttggctttgacaagctaaggccggctggtggagcacatcgagttctggaggttcatgtgtgttttcatgaagatctgtctgcccgtagcagataaagagttgttgccccactcctcctggggtcttctattttcctgggaggaatttctggattaactgaacacacacacacacacacacacccttttgaagcatcaacagtaattctgagttcttagggacaatgcagattaaatccacaataagaaagacaactatggccaggtgtggtggctcacgcctgtaatcccagaactttgggaggctgaggcggatggatcacctgaggtcaggagttagagaccaacctgaccaacatggagaaaccccgtttctactaaaaatgcaaaattagccgggcatggtggcaggcgcctgtaatcccaaatactcgggaggctgaggcaggagaatcacttaaacccgggaggcagaggttgcagtgagccaagatcgcgccattgcactccagcctgggcaagaagagcaaaactccatctcaaaaaaaaaaaaaaagagtactattgatccagaggtgaccagactagcctcactggagataataggtgacattattatgcaaagtggtttcagttcccttgtcttgtttttggaatagtataagaggcctacaatacgaataaataaggcccatcacaagcctcaccaaaggacaaaactaatccacttctgaagaaggctctttgttgggccagatcaaatccttggacagaactgtactcttaatctctgtagtgaaagtggggggtagtttaagaatttattaaccttctaccttgagcaatccctcagaagtaagaggtgtcaggcctctgagccgaagctcagccattgtaacccctgtgacctgcacatatatgtccagatggcctgcaggagccaagaagtctggggcagctgaaaaaccacacaagaagtaaaacagccagttcctgccttaactgattaaccaacattacaacattccaccattgtgacctgtccctgtcctaccttaactgatcaatcgaccttgtgacagtcttcttctggacaatgggtcttatcatctccccaccatgtaccttgtgaccccctcctctgctaacaatagataaccactttttactgtaattttccattacctacccaactcctataaagcaaccccttccccatctcccttcactgactctgttttcagactcagcccacttgcactcaagtgaataaacagccttgttgctcacacaaagcctgttggtggtctcttcacacagatgtgcttgacaaaagggaagggtggatttgtccttctggttacatatgttctgctcactcattttgaatttaattaaacaaggattgcccttaccttttcatactttgtaagaaaccataaatacttatgcaccatgatttttttaaagaaacactttttattttgaagtaattatagtctcataggaagttgcaaaagtagtacatagagtccctgagtactcttcccccagtggtgacaactgtagtataatatcaattctgggaaattgacattggtacaataccaaatatactatgcctttttctctaaggcatgatgttgcagtagcatccttgtacatgtagctaggagaacttgtactaagcccagataaatagttgaagtacaagggcaaggagtgtgtctttgatattttaatagaaatcacctattgccctctagaaaagctgtacccttttccagtggcagagaaccttcctgaaaggcagtcctgtgtaatggtgtccatttcatcacacccttaaaacactcagctttaacaaacatgcagatttttgctgatgtgggagaaaatattaattattaatgatattaaggtgattatcttttcgtatgtttatagatatttgtatttctttttaaatgaactgctcatgacctttgtctacttttatttgggtttacttctttctcatttattcctataaactctttataaaaggaaattaaccatttgattgtcatatgttgtgaatatttttaccattttgacttttgaatttatgtctttttaatgaattgtagaagtttaaaatctttatggaataaatttatttagttttt

SEQ ID NO: 290058 - DNA, 2425 bp, Homo sapiens
gcgcccctccaccatctaccttccgcctgactggggcttgcctttccgggctggcgggtgccacttcggataaaccctttggactcctaactccaatcaggtgtctgctttgttgaggactcacagacacagtctcctttcttcaagatctttacaatgcaagacctcactaacacacagggatggtctcccagagggtctgtgctgttccttcactcagaacatcaagatgcactgaagtaaggatcctctattctacagttcctgctagctgagctattccatgggggcttcagcaggaaattccaaggttggctttgacaagctaaggccggctggtggagcacatcgagttctggaggttcatgtgtgttttcatgaagatctgtctgcccgtagcagataaagagttgttgccccactcctcctggggtcttctattttcctgggaggaatttctggattaactgaacacacacacacacacacacacccttttgaagcatcaacagtaattctgagttcttagggacaatgcagattaaatccacaataagaaagacaactatggccaggtgtggtggctcacgcctgtaatcccagaactttgggaggctgaggcggatggatcacctgaggtcaggagttagagaccaacctgaccaacatggagaaaccccgtttctactaaaaatgcaaaattagccgggcatggtggcaggcgcctgtaatcccaaatactcgggaggctgaggcaggagaatcacttaaacccgggaggcagaggttgcagtgagccaagatcgcgccattgcactccagcctgggcaagaagagcaaaactccatctcaaaaaaaaaaaaaaagagtactattgatccagaggtgaccagactagcctcactggagataataggtgacattattatgcaaagtggtttcagttcccttgtcttgtttttggaatagtataagaggcctacaatacgaataaataaggcccatcacaagcctcaccaaaggacaaaactaatccacttctgaagaaggctctttgttgggccagatcaaatccttggacagaactgtactcttaatctctgtagtgaaagtggggggtagtttaagaatttattaaccttctaccttgagcaatccctcagaagtaagaggtgtcaggcctctgagccgaagctcagccattgtaacccctgtgacctgcacatatatgtccagatggcctgcaggagccaagaagtctggggcagctgaaaaaccacacaagaacattgtgacctgtccctgtcctaccttaactgatcaatcgaccttgtgacagtcttcttctggacaatgggtcttatcatctccccaccatgtaccttgtgaccccctcctctgctaacaatagataaccactttttactgtaattttccattacctacccaactcctataaagcaaccccttccccatctcccttcactgactctgttttcagactcagcccacttgcactcaagtgaataaacagccttgttgctcacacaaagcctgttggtggtctcttcacacagatgtgcttgacaaaagggaagggtggatttgtccttctggttacatatgttctgctcactcattttgaatttaattaaacaaggattgcccttaccttttcatactttgtaagaaaccataaatacttatgcaccatgatttttttaaagaaacactttttattttgaagtaattatagtctcataggaagttgcaaaagtagtacatagagtccctgagtactcttcccccagtggtgacaactgtagtataatatcaattctgggaaattgacattggtacaataccaaatatactatgcctttttctctaaggcatgatgttgcagtagcatccttgtacatgtagctaggagaacttgtactaagcccagataaatagttgaagtacaagggcaaggagtgtgtctttgatattttaatagaaatcacctattgccctctagaaaagctgtacccttttccagtggcagagaaccttcctgaaaggcagtcctgtgtaatggtgtccatttcatcacacccttaaaacactcagctttaacaaacatgcagatttttgctgatgtgggagaaaatattaattattaatgatattaaggtgattatcttttcgtatgtttatagatatttgtatttctttttaaatgaactgctcatgacctttgtctacttttatttgggtttacttctttctcatttattcctataaactctttataaaaggaaattaaccatttgattgtcatatgttgtgaatatttttaccattttgacttttgaatttatgtctttttaatgaattgtagaagtttaaaatctttatggaataaatttatttagttttt

SEQ ID NO: 290059 - DNA, 2677 bp, Homo sapiens
gcgcccctccaccatctaccttccgcctgactggggcttgcctttccgggctggcgggtgccacttcggataaaccctttggactcctaactccaatcaggtgtctgctttgttgaggactcacagacacagtctcctttcttcaagatctttacaatgcaagacctcactaacacacagggatggtctcccagagggtctgtgctgttccttcactcagaacatcaagatgcactgaagtaaggatcctctattctacagttcctgctagctgagctattccatgggggcttcagcaggaaattccaaggttggctttgacaagctaaggccggctggtggagcacatcgagttctggaggttcatgtgtgttttcatgaagatctgtctgcccgtagcagataaagagttgttgccccactcctcctggggtcttctattttcctgggaggaatttctggattaactgaacacacacacacacacacacacccttttgaagcatcaacagtaattctgagttcttagggacaatgcagattaaatccacaataagaaagacaactatggccaggtgtggtggctcacgcctgtaatcccagaactttgggaggctgaggcggatggatcacctgaggtcaggagttagagaccaacctgaccaacatggagaaaccccgtttctactaaaaatgcaaaattagccgggcatggtggcaggcgcctgtaatcccaaatactcgggaggctgaggcaggagaatcacttaaacccgggaggcagaggttgcagtgagccaagatcgcgccattgcactccagcctgggcaagaagagcaaaactccatctcaaaaaaaaaaaaaaagagtactattgatccagaggtgaccagactagcctcactggagataataggtgacattattatgcaaagtggtttcagttcccttgtcttgtttttggaatagtataagaggcctacaatacgaataaataaggcccatcacaagcctcaccaaaggacaaaactaatccacttctgaagaaggctctttgttgggccagatcaaatccttggacagaactgtactcttaatctctgtagtgaaagtggggggtagtttaagaatttattaaccttctaccttgagcaatccctcagaagtaagaggtgtcaggcctctgagccgaagctcagccattgtaacccctgtgacctgcacatatatgtccagatggcctgcaggagccaagaagtctggggcagctgaaaaaccacacaagaagtaaaacagccagttcctgccttaactgattaaccaacattacaacattccaccattgtgacctgtccctgtcctaccttaactgatcaatcgaccttgtgacagtcttcttctggacaatgggtcttatcatctccccaccatgtaccttgtgaccccctcctctgctaacaatagataaccactttttactgtaattttccattacctacccaactcctataaagcaaccccttccccatctcccttcactgactctgttttcagactcagcccacttgcactcaagtgaataaacagccttgttgctcacacaaagcctgttggtggtctcttcacacagatgtgcttgacaaaagggaagggtggatttgtccttctggttacatatgttctgctcactcattttgaatttaattaaacaaggattgcccttaccttttcatactttgtaagaaaccataaatacttatgcaccatgatttttttaaagaaacactttttattttgaagtaattatagtctcataggaagttgcaaaagtagtacatagagtccctgagtactcttcccccagtggtgacaactgtagtataatatcaattctgggaaattgacattggtacaataccaaatatactatgccttattcagttttcattattttttacatgcactcatttgtgtgtgtcaatgtgtgtctgtgcttctctgcttgtgatgtatttaggagaattttgactagcgagccatacagatctactccattcttattcctttgttcattatctggatgaactatcacttaccagtcccctattggaatccacttcagttgtttatggtttttctctaaggcatgatgttgcagtagcatccttgtacatgtagctaggagaacttgtactaagcccagataaatagttgaagtacaagggcaaggagtgtgtctttgatattttaatagaaatcacctattgccctctagaaaagctgtacccttttccagtggcagagaaccttcctgaaaggcagtcctgtgtaatggtgtccatttcatcacacccttaaaacactcagctttaacaaacatgcagatttttgctgatgtgggagaaaatattaattattaatgatattaaggtgattatcttttcgtatgtttatagatatttgtatttctttttaaatgaactgctcatgacctttgtctacttttatttgggtttacttctttctcatttattcctataaactctttataaaaggaaattaaccatttgattgtcatatgttgtgaatatttttaccattttgacttttgaatttatgtctttttaatgaattgtagaagtttaaaatctttatggaataaatttatttagttttt

SEQ ID NO: 290060 - DNA, 2797 bp, Homo sapiens
gcgcccctccaccatctaccttccgcctgactggggcttgcctttccgggctggcgggtgccacttcggataaaccctttggactcctaactccaatcaggtgtctgctttgttgaggactcacagacacagtctcctttcttcaagatctttacaatgcaagacctcactaacacacagggatggtctcccagagggtctgtgctgttccttcactcagaacatcaagatgcactgaagtaaggatcctctattctacagttcctgctagctgagctattccatgggggcttcagcaggaaattccaaggttggctttgacaagctaaggccggctggtggagcacatcgagttctggaggttcatgtgtgttttcatgaagatctgtctgcccgtagcagataaagagttgttgccccactcctcctggggtcttctattttcctgggaggaatttctggattaactgaacacacacacacacacacacacccttttgaagcatcaacagtaattctgagttcttagggacaatgcagattaaatccacaataagaaagacaactatggccaggtgtggtggctcacgcctgtaatcccagaactttgggaggctgaggcggatggatcacctgaggtcaggagttagagaccaacctgaccaacatggagaaaccccgtttctactaaaaatgcaaaattagccgggcatggtggcaggcgcctgtaatcccaaatactcgggaggctgaggcaggagaatcacttaaacccgggaggcagaggttgcagtgagccaagatcgcgccattgcactccagcctgggcaagaagagcaaaactccatctcaaaaaaaaaaaaaaagagtactattgatccagaggtgaccagactagcctcactggagataataggtgacattattatgcaaagtggtttcagttcccttgtcttgtttttggaatagtataagaggcctacaatacgaataaataaggcccatcacaagcctcaccaaaggacaaaactaatccacttctgaagaaggctctttgttgggccagatcaaatccttggacagaactgtactcttaatctctgtagtgaaagtggggggtagtttaagaatttattaaccttctaccttgagcaatccctcagaagtaagaggtgtcaggcctctgagccgaagctcagccattgtaacccctgtgacctgcacatatatgtccagatggcctgcaggagccaagaagtctggggcagctgaaaaaccacacaagaagtaaaacagccagttcctgccttaactgattaaccaacattacaacattccaccattgtgacctgtccctgtcctaccttaactgatcaatcgaccttgtgacagtcttcttctggacaatgggtcttatcatctccccaccatgtaccttgtgaccccctcctctgctaacaatagataaccactttttactgtaattttccattacctacccaactcctataaagcaaccccttccccatctcccttcactgactctgttttcagactcagcccacttgcactcaagtgaataaacagccttgttgctcacacaaagcctgttggtggtctcttcacacagatgtgcttgacaaaagggaagggtggatttgtccttctggttacatatgttctgctcactcattttgaatttaattaaacaaggattgcccttaccttttcatactttgtaagaaaccataaatacttatgcaccatgatttttttaaagaaacactttttattttgaagtaattatagtctcataggaagttgcaaaagtagtacatagagtccctgagtactcttcccccagtggtgacaactgtagtataatatcaattctgggaaattgacattggtacaataccaaatatactatgcctttttctctaaggcatgatgttgcagtagcatccttgtacatgtagctaggagaacttgtactaagcccagataaatagttgaagtacaagggcaaggagtgtgtctttgatattttaatagaaatcacctattgccctctagaaaagctgtacccttttccagtggcagagaaccttcctgaaaggcagtcctgtgtaatggtgtccatttcatcacacccttaaaacactcagctttaacaaacatgcagatttttgctgatgtgggagaaaatattaattattaatgatattaaggtgattatcttttcgtatgtttatagatatttgtatttctttttaaatgaactgctcatgacctttgtctacttttatttgggtttacttctttctcatttattcctataaactctttataaaaggaaattaaccatttgattgtcatatgttgtgaatatttttaccattttgacttttgaatttatgtctttttaatgaattgtagaagtttaaaatctttatggaataaatttatttagtttttaaaaaaaaaaaaaaaaaacaaaaaaaaaacaaaaaaaaaaacaaaacaggagagcaacacgataaaacaaacaacagagagaaggaacacaaaggaacataaacgaaccagaagcgggagacaacagcacaagatacatgcagccaccatctatgagaagcgaaggacgggccctacccttgcagtcaaggccgctcgaatagagcgaagaagcagccgcagacggagcacagacatgcggagagacaacgagcgactccaaacaagagaggcgagagaacaagcaagcgaggagcgcgcccaatgacgggaactacta

SEQ ID NO: 290061 - DNA, 1379 bp, Homo sapiens
  misc_feature (192)..(192): n is a, c, g, or t
  misc_feature (263)..(264): n is a, c, g, or t
  misc_feature (1257)..(1257): n is a, c, g, or t
  misc_feature (1266)..(1266): n is a, c, g, or t
agcgggcaccgaggcgcggagcgcggcgcacggcggtgcccaggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggnggcatgttcgccgcggtggagggcgcctacgagaacaagaccatcgacttcgacgcctacagtgtgggccnncgcggctcggcgcacacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaaggccctagtttngggaagccnttgcgccagctgggccggtggcccattatggccaaactggcaggttggggtcgggattccttccttgaccggctaccgccgattgctctcttggcggggtttggcctagcggc

SEQ ID NO: 290062 - DNA, 536 bp, Homo sapiens
atcacctttttcaggaatgtcggattttactggggattttgacaagaacaccacaaggtggtcagggctgaaggtggggggagcccagggactgaggggcacagaagagggagcagtggactctgtggaggccagggaggcttcccatggctggtcctggactgagccctgaatgaaggtgggtccagtggagtgcatggcagagtacatggcctccaggagcagcgtggaactgatgctaacagatcccatccagcagcgattggcgctctctttcaggtgcccagatagatgacaacaatcccaggcgcaccggccaccgcatcgtggcgccccctggtggccgctccaacatcaccagcctcggttgaacgtggattccatgcagtgtggtgcagtggattctgattgaatgcagtggattccatgcagcctgtgttgaatgcagtgtatgccatacagcgcgaagaaatggaaccctatcgaatgcaatggattttactgcggcatgattgatcgcagtggatgtacatgca

SEQ ID NO: 290063 - DNA, 161 bp, Homo sapiens
agaacatacatgaagatgggcccgttgctgctgccttgtctgggactcaggggtcctttccgggggtgggtaggtggtagtgtcaggcaaagtgacttctctttggaagggatttggggtcctcctgcagttggccactcacgccaacgggatcctctaga

SEQ ID NO: 290064 - DNA, 3131 bp, Homo sapiens
  misc_feature (192)..(192): n is a, c, g, or t
  misc_feature (263)..(264): n is a, c, g, or t
agcgggcaccgaggcgcggagcgcggcgcacggcggtgcccaggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggnggcatgttcgccgcggtggagggcgcctacgagaacaagaccatcgacttcgacgcctacagtgtgggccnncgcggctcggcgcacacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290065 - DNA, 3256 bp, Homo sapiens
ctcagatctccagactgaccccagggaacgccctggtacggggaacctaggacttaacaactccaaggaagggagtgtaggagttggggagggacagtgtccccatctgcaatttccggtcattgacagggattttaggccccgctgagagccagggatgcatgaatgcgtggagggaaatgagttgtaaacagagtgtaggggaacctggcatctccatgctgctttgctgcagctaatatgttttgcacccggggtacatcattttacctctgtaagcctcaatttcctgtctgtaaaatgggaaaattatgcctagtgttcctgggatactgagctggcttctctgtgaagctaaaacctcacctctattttaaggcccaggtgtctctggcctcctgccctggattaggggactggcccctggggtggtgaaggtcagggccccagcccccaaccacagtgctgggggagctgtaccaagcctaggccaccctcgctctggatggcaacttgaaagcagaaaagatgagtagtttcataggacctgtggggttggatttcgcatgcagaaaatgaacaacgaagtggtggacaagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290066 - DNA, 2688 bp, Homo sapiens
ctaggtgagccgggggtgaatcggacgagggagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290067 - DNA, 3072 bp, Homo sapiens
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgaaaaaaaaacacaccacacaaacaaag

SEQ ID NO: 290068 - DNA, 3411 bp, Homo sapiens
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgacctgactagggcactttcatttcagtggtggtgtctggattgggtacgaatgcttggcagtccccccgcgtgataacgaatggtggtggctgcttcctgaggactcactcttggtagagactggtggatgtgggggtgggaggagagattcagttcatgacttctgaaggctgagttcctgagacccaaggaggcgaagagagggaagacggctgatgggcgggcttccacaaaataggctcaaatcttgcattgattccctcctgttgggcctttcctggctctctttcttcttgtattgtatggatcagcctcagactggaagctccaatctcctaaacttcacatttcttccttccatttcc

SEQ ID NO: 290069 - DNA, 3408 bp, Homo sapiens
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactgaaaaaaaaaaaaaaaaaaaaaaaaaaaaaaaaaaaaaaaaaaaaaaaaaaaaaaaaaaaaaaaaaaaaaaagggcgggcgcgccgcgcccataaaaaatcctcttcccgcggcggggcgcgccacttaccgtccttcccgcccccccggttgtttggtgaaaaaggggcggccccccttacgatggggtggctattctatttcctcccgcgcctgccgcggcgcgcgggcgcttaatacacatccggtctgcggtgcgggactgcacttcctcctcttctcttcctcgttcttctcgggcggcgagcgcccctctcctcctccgtgcggcgcgcactttgtcgggcgccttctcccccctggg

SEQ ID NO: 290070 - DNA, 2570 bp, Homo sapiens
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcagcctgtcggctagtcgggtaagatcctgtagagtcacttcgc

SEQ ID NO: 290071 - DNA, 1861 bp, Homo sapiens
agaacatacatgaagatgggcccgttgctgctgccttgtctgggactcaggggtcctttccgggggtgggtaggtggtagtgtcaggcaaagtgacttctctttggaagggatttggggtcctcctgcatgaagctttgtgtgtatgagtatgcgtgtgtgtaagtgtatatatgggtgtgcatacctgtatgagtgtgtgtgtgggcatgtatgcatgtgtatacatatgtgagtatgcctttgtgaagatctgtatgtgatttaagtgtgtgtgcgtgttcacgcgtgtatgctactgtgtaggcctgttttgttactgcatgtgcatgcatatatgtgtgcatgactgcatgtatgtgagtgcgtgtgcgtggtgtgtgcgtctgtatgtgtatgcatgtgggtatgtagatgtgtgtgtatgcatgcttgtgtgtatgaatgcctgtgtgcggctgcatgtgtgtgaagtgcacctgtcgtgtgtgcgtgttgtgtgtgtgtgtgcatgcacatttgaagtgacctcaggtttctctctcgcccgcagggctctgctttatctgcccagaagggcacacatgcacagtgtcgatcaatcacactctcccttcctctgtttaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290072 - DNA, 1348 bp, Homo sapiens
atcacctttttcaggaatgtcggattttactggggattttgacaagaacaccacaaggtggtcagggctgaaggtggggggagcccagggactgaggggcacagaagagggagcagtggactctgtggaggccagggaggcttcccatggctggtcctggactgagccctgaatgaaggtgggtccagtggagtgcatggcagagtacatggcctccaggagcagcgtggaactgatgctaacagatcccatccagcagcgattggcgctctctttcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290073 - DNA, 1294 bp, Homo sapiens
  misc_feature (1172)..(1172): n is a, c, g, or t
  misc_feature (1181)..(1181): n is a, c, g, or t
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaaggccctagtttngggaagccnttgcgccagctgggccggtggcccattatggccaaactggcaggttggggtcgggattccttccttgaccggctaccgccgattgctctcttggcggggtttggcctagcggc

SEQ ID NO: 290074 - DNA, 868 bp, Homo sapiens
agaacatacatgaagatgggcccgttgctgctgccttgtctgggactcaggggtcctttccgggggtgggtaggtggtagtgtcaggcaaagtgacttctctttggaagggatttggggtcctcctgcatgaagctttgtgtgtatgagtatgcgtgtgtgtaagtgtatatatgggtgtgcatacctgtatgagtgtgtgtgtgggcatgtatgcatgtgtatacatatgtgagtatgcctttgtgaagatctgtatgtgatttaagtgtgtgtgcgtgttcacgcgtgtatgctactgtgtaggcctgttttgttactgcatgtgcatgcatatatgtgtgcatgactgcatgtatgtgagtgcgtgtgcgtggtgtgtgcgtctgtatgtgtatgcatgtgggtatgtagatgtgtgtgtatgcatgcttgtgtgtatgaatgcctgtgtgcggctgcatgtgtgtgaagtgcacctgtcgtgtgtgcgtgttgtgtgtgtgtgtgcatgcacatttgaagtgacctcaggtttctctctcgcccgcagggctctgctttatctgcccagaagggcacacatgcacagtgtcgatcaatcacactctcccttcctctgtttaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtaggaaagagtggtggcccaggctccccacaattgcagcagttcaggccgagtccttcctgctgcttctgaggaa

SEQ ID NO: 290075 - DNA, 3046 bp, Homo sapiens
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290076 - DNA, 936 bp, Homo sapiens
  misc_feature (192)..(192): n is a, c, g, or t
  misc_feature (263)..(264): n is a, c, g, or t
agcgggcaccgaggcgcggagcgcggcgcacggcggtgcccaggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggnggcatgttcgccgcggtggagggcgcctacgagaacaagaccatcgacttcgacgcctacagtgtgggccnncgcggctcggcgcacacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcagtgagtgacactgtcccctgccttagggacatagactgtgaggtctcctccccatcaccagcatcacaagtgctcagtgtgttcgaggctctctgcccagggtgccattggatttcattctccccccagccctatgacacaggtcactgttttacagagcataccgtgtgtgccactggggccacaga

SEQ ID NO: 290077 - DNA, 2861 bp, Homo sapiens
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290078 - DNA, 2206 bp, Homo sapiens
agatcggaagggaagcgcttcctggttcgagccgagaggggcgaatccggcttcgctccgcgccgccgggaggagctgtctgcagccccctcctcccgccctcgcctctccctcctccttctcccgccctcctcgccgatccgggcggtgctggcagccggagcggcggcgggcgggccgagcagccggggcagccgcgcgtgggcatccacgggcgccgagcctccgtccgtgtctctatccctcccgggcctttgtcagcgcgcccgctgggagcggggccgagagcgccggttccagtcagacagccccgcaggtcagcggccgggccgagggcgccagagggggccatgtcgtaccagggcaagaagagcatcccgcacatcacgagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggctgatgacttcttccaagggaccagggcggcactggtgggcgggaccacgatgatcattgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggcgtcaattccttccaagtctacatggcctataaggatgtctaccaaatgtccgacagccagctctatgaagcctttaccttccttaagggcctgggagctgtgatcttggtccatgcagaaaatggagatttgatagctcaggaacaaaagcggatcctggagatgggcatcacgggtcccgagggccatgccctgagcagacctgaagagctggaggccgaggcggtgttccgggccatcaccattgcgggccggatcaactgccctgtgtacatcaccaaggtcatgagcaagagtgcagccgacatcatcgctctggccaggaagaaagggcccctagtttttggagagcccattgccgccagcctggggaccgatggcacccattactggagcaagaactgggccaaggctgcggcgttcgtgacttcccctcccctgagcccggaccctaccacgcccgactacttgacctccctactggcctgtggggacttgcaggtcacaggcagcggccactgtccctacagcactgcccagaaggcggtgggcaaggacaactttaccctgatccccgagggtgtcaacgggatagaggagcggatgacggtcgtctgggacaaggcggtggctactggcaaaatggatgagaaccagtttgtcgctgtcaccagcaccaatgcagccaagatctttaacctgtacccaaggaaagggcggattgccgtgggctcggatgccgacgtggtcatctgggaccccgacaagttgaagaccataacagccaaaagtcacaagtcggcggtggagtacaacatcttcgagggtatggagtgccacggctccccactagtggtcatcagccagggcaagatcgtctttgaagacggaaacatcaacgtcaacaagggcatgggccgcttcattccgcggaaggcgttcccggagcacctgtaccagcgcgtcaaaatcaggaataaggtttttggattgcaaggggtttccaggggcatgtatgacggtcctgtgtacgaggtaccagctacacccaaatatgcaactcccgctccttcagccaaatcttcgccttctaaacaccagcccccacccatcagaaacctccaccagtccaacttcagcttatcagcattaccagagcctgcagctcctgagaatcgcacaatagcccttcggctgcaatcattctttccgtcagagtcatcatcagctgtcgggctttggagctggaacacttaaactggtccacaagaaagtgctggatatttgccatctgtttccagaaagcttccatctgtgaaatgagcacaagcagcaagaagtgaggtgaaaaacttacttaagaaagccaaacggtg

SEQ ID NO: 290079 - DNA, 1236 bp, Homo sapiens
  misc_feature (192)..(192): n is a, c, g, or t
  misc_feature (263)..(264): n is a, c, g, or t
agcgggcaccgaggcgcggagcgcggcgcacggcggtgcccaggccgcgggcgggcaggcgggagcgcggtgggtggccggccttggacgggtatggcggaccggcggcgcgcgtggaacaccgaggacgacctgcccgtgtacctggcgcggccgggcagcgcggcgcagaccccgcgccagaagtacggnggcatgttcgccgcggtggagggcgcctacgagaacaagaccatcgacttcgacgcctacagtgtgggccnncgcggctcggcgcacacgccgcgcagcgctggccggcccgacgcggtcgggctgccagggccgggaggcagcgaggacacggccagcgacgtgagcgagccctcgggctccgcggtcagctctcccggagagcgcgacgagcggccgccgacgctgcgcatccgccgccccgcgccccgcgacctgcccctcggccgggacaatggccagagtgaccgactcctcatcaaaggtggacggatcatcaacgatgaccaatccctttatgctgacgtctacctggaggatggacttatcaaacaaataggagagaacttaatcgttcctggtggagtgaagaccattgaagccaacgggcggatggttattcccggaggtattgatgtcaacacgtacctgcagaagccctcccaggggatgactgcggtgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaacaaccaacttgttgtggctcttatttctgaattcaaagcttgtgaaaaaataaagaaaatgaactgcccactga

SEQ ID NO: 290080 - DNA, 672 bp, Homo sapiens
cggtccggagcctctggacctcggcagccagctcctccacctggcggcaggactgctggccggtgcacgcctgcagctgctgcagcctcctagtctcctcctccgcctgcgacagccgcttctccagctccaggtagtctcgcaccagctcctgcttgctgcggccctgcaggctctcggtgtggaagcgttccccagctcagctccaggtagggtcgccagtgccttttgcgcttcgatggccgccgacggtgtttcttccgggccagcacagcctccgctgagcagccccctgggctctgggtccggggactcctactgttccagcccaggccaccgacagccccagcaagatcttcatcctctgagtggctctccatccgcggtgtcaggggcagggaaccaccagagtcatgacgctcagggggtgtttgggggctccccggggcaccagaggtctaaagagagggaggaggaagaaggatggatcagacagcctgtccttggaggtggaacctttccctctctacctagcctgaagcctaccttcctacactcagctaacttggtcactcttagcccctcaaccttttggaaccatttgtttacaaagagacctgtctactgtctgtcccccaaccttccccaagtaaactcatggtgagagcagga

SEQ ID NO: 290081 - DNA, 920 bp, Homo sapiens
aaaaggtagatttaatgcagtaacaataatctgaggataaataaatccacgacagactttaaagtttgcaaatctgtttcctttctttgcagagaaaatggttttctgaaagcacacaggactgaagatgtcaaaacaaaacttaatttcttagtctccaggtgacacaggcttggtcctctctgctgccctccgaacacttgtcactggccaagatggtagtttctcttgtttagctcaggatggatgttagtttcaagaataactggatggtttgtttcctgaatcatcttcttgtgagcccatactcttttggtacaaacgtgagggattcactggtgaatctccgtggtccagtggcattacagcccgtctcactccagcttcaagtgcaacttcagccactcttccgtgactcaagtgatatatgacagcattggccctgggcctctattactactctttctcaagggccttactcagtggcacaaccgtgcaccatatacccgctccctatcgtgagctctaactacgtatgccaaaacaaactctcgaccaatcattcgtactcactggctgccagaaaccgctattctcctcatgaccatacctggaaggtcccagcaacaacgtggcaacacggaactatggccataatctatggtcaactgatacgacgttcaacacacggctccaagcgtaacgcctctcctgaaaccttagttccctcacccctctcagttcaacccgcacgaaagtggcagcagaaggggcaaaatagcgccctatccaaccacgaggacaccaccaaattgatcacggctctaatacccgacgaaagataaaaaacagcggctaaatccacaatggggcttgcgccactccaattgacaaacccaaaagggaccacagccgggaca

SEQ ID NO: 290082 - DNA, 334 bp, Homo sapiens
gacaagattgtgccactgcactccagcctgggcaacagagcgaaactccgtctcaaaagaaaaaaaaaaatttgcccctggcaaatgcatacacctcatactagcctcacgaaactggaataagcctttgaaagaagtttgtccttaagagaaaatggttttctgaaagcacacaggactgaagatgtcctccgaacacttgtcactggccaagatggtagtttctcttgtttagctcaggatggatgttagtttcaagaataactggatggtttgtttcctgaatcatcttcttgtgagcccatactctgtaaaggtaaagtgaagttatgta

SEQ ID NO: 290083 - DNA, 227 bp, Homo sapiens
ggaaaggagcatgcgctggaagctgtgtgctgttggttttgaggatcttcagtaagctgaaagcggagagtcaggggccttgtgtcctaccatggtatttgctaacgtttagagagtgcttccccttgccgagcactggcaagaaggccctcaccagatgccagcaccttgacattggactttccagcctccagaaatgtgagaaataaatgtctttactttataaa

SEQ ID NO: 290084 - DNA, 826 bp, Homo sapiens
ctaggtgaggccggggtgaatcggccgaggcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgtgtcacgggtggggtcccgggtccctctgggggggctttgccccaaccttggtgccctgtgacggggctttttcgggcgctccccgggtggtgcggtgccggtcgggtactagctgactgggcctgtgtcggtgctcccccatt

SEQ ID NO: 290085 - DNA, 367 bp, Homo sapiens
agctcggtacccgccgccgggattcctacgcactactacatcgagagcacaggtgcggcctggccctccccagcccagggaccctggagggagcggggaggaaggagtgtgcagagtgtcaccattcaggtgtcctgggaaaggtaacctgcccagtcgttcagaattggagccgagttcacggagacagagaaccagacagacagaagacccagagccctgggccactccactcctgatgatttagctgccggtcccactctgaccttttggaaagaggctgtgtgaggaaggagtagcctggttgggggtctcactggcctgactctgcaaggaagcgcacagccccaggactgcgaggacgggg

SEQ ID NO: 290086 - DNA, 3953 bp, Homo sapiens
gaattacagcttctaagttatgtgacaagagccctgagcccacagtgtccactcaggcccagagctgacagcagccttctgtgggcccaggaccatgtgtccctgtctctgtacccatcctagggtttgaaggaaaccgatgctgctgccccctgataaagggctgggcatgcatgcgttctcagaggactgtgtcctgagcctggaaggacttttgtcttcttaaatattgaagcattcactgtaaacttccatttcccagttgccagcagctgtcttcccccacctctcccagacaggacctcccctttctgggctttggcaggagagggtgaagttttcaagccggggtgcccctctttaccctactcacccttgtttcccaaacatcattagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290087 - DNA, 3944 bp, Homo sapiens
agctcggtacccgccgccgggattcctacgcactactacatcgagagcacaggtgcggcctggccctccccagcccagggaccctggagggagcggggaggaaggagtgtgcagagtgtcaccattcaggtgtcctgggaaaggtaacctgcccagtcgttcagaattggagccgagttcacggagacagagaaccagacagacagaagacccagagccctgggccactccactcctgatgatttagctgccggtcccactctgaccttttggaaagaggctgtgtgaggaaggagtagcctggttgggggtctcactggcctgactctgcaaggaagaggtggctgcacttcccccagcttccagctccagaccttcaggccccagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290088 - DNA, 3310 bp, Homo sapiens
ggcagaagcagagatcaggtacccgggaggcacgcaggcagcttcccctccagctccaggccgacgccctgctggcagcccaccctgcggtcccagtgggggaccctgggaagtggtccccaccaggtctggcctcatctcaccctcttttcagggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290089 - DNA, 4196 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacaggtggggagcaagttaggcagtctgaaccacttgagttttattttattttattttattttttgagatagagtctcgctccgtcacccaggatggagtgcagtggtacaatctcggctcactgcaacctccacctcccgggttccggatccaagcgattcctgtgcctcagcctcccgagtacctgggattacagacatgcaccaccacacccagctaatttttatagttttagtagagactgggtttccccatgttggccaggcaggtctcgaactcctgacctcaggtgatccgcccacctcagcctcccaaagtgctgggattacagacatgagccaccgtgcctgccctgagttttactctttggccacagccctggggtccagtcagggagggagatggggtcccacaagcaggggagagcagggtgagccgggagcgcctccacaccggcttctatctctcagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290090 - DNA, 1788 bp, Homo sapiens
tggcgaattcggcacgagggagggctgcctcctccgcctagagcgctgccgccgccgctttcgcccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290091 - DNA, 3813 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcatagcatttgcacggtgtcttccccggacagcacagcaataaatggtgtgattgcgtggactcgtgccgaattcggcacgagctggggcagcttccgcgcctacctgtccacgtgctaacagatcatgacgcccccagcacccctgcctgcttttgctggtggcagtgacgggaccccgactcttactctcggccgag

SEQ ID NO: 290092 - DNA, 2846 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290093 - DNA, 3011 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtggagacaccgtggctctgttcttggccaagtttccccaccttctgcccaggactccactgctaattcgggcccatcttcctccccaaggaagacaaattctttttctagcgctgcagcagggaggtggggtgggcggtaaacagacaggctctggcagtgcagatctg

SEQ ID NO: 290094 - DNA, 2404 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcctgggtcggggtttcgtacgtagcagaggcagcttactgattgccaccccctggccccttaatggccaccttaactaagggtgtgaacgggctgacttggtgaattgggcaactccttatagtgttgtgcacacaaaagcatcaaataaagaacatttaatc

SEQ ID NO: 290095 - DNA, 1237 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggaggctgcagtgaactgttatcgtgagaccgcacgtctcctaggaggcagagcaagacactgtctct

SEQ ID NO: 290096 - DNA, 2257 bp, Homo sapiens
gaaggccccgtgcggtgtgtttaactcggcgaggccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290097 - DNA, 3729 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290098 - DNA, 4067 bp, Homo sapiens
gcgctgccgccgccgctttcgcccgggagccgggggccgggcgccatcatgctgagccggctcggggcgctgctgcaggaagccgtgggggcgacaactccaggaccttgttggggtgcaggacgcccttcccgtcaccccgggacgtgggaagtgcaggccctgccggtccaagtccccacgaaggcgcgagcccagcattgacctgctgcaggccttcgtggagcactggaagggcatcacgcactactacatcgagagcacaggtaacctgcccagtcgttcagaattggagccgagttcacggagacagagaaccagacagacagaagacccagagccctgggccactccactcctgatgatttagctgccggtcccactctgaccttttggaaagaggctgtgtgaggaaggagtagcctggttgggggtctcactggcctgactctgcaaggaagaggtggctgcacttcccccagcttccagctccagaccttcaggccccagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290099 - DNA, 3914 bp, Homo sapiens
gcgctgccgccgccgctttcgcccgggagccgggggccgggcgccatcatgctgagccggctcggggcgctgctgcaggaagccgtgggggcgacaactccaggaccttgttggggtgcaggacgcccttcccgtcaccccgggacgtgggaagtgcaggccctgccggtccaagtccccacgaaggcgcgagcccagcattgacctgctgcaggccttcgtggagcactggaagggcatcacgcactactacatcgagagcacaggtgcggcctggccctccccagcccagggaccctggagggagcggggaggaaggagtgtgcagagtgtcaccattcaggtgtcctgggaaagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290100 - DNA, 3823 bp, Homo sapiens
gcgctgccgccgccgctttcgcccgggagccgggggccgggcgccatcatgctgagccggctcggggcgctgctgcaggaagccgtgggggcgacaactccaggaccttgttggggtgcaggacgcccttcccgtcaccccgggacgtgggaagtgcaggccctgccggtccaagtccccacgaaggcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290101 - DNA, 3638 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290102 - DNA, 2971 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290103 - DNA, 1358 bp, Homo sapiens
gcgagctgtctatgagtatccctcgtgatccgatctctgcgcgtttgacacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcctcatggcaaatgcccaaagcatgttccgcacccaggcgggggcccctgctaatgagaaccttggtgcagctgcagccaggaggggagcgggcccaggagccaggctcaggtccagctggttcctctctggcgccttctgaacccgtctcagcaggtccacagcacctgggcagaggtcagagaccaggggaggccgggccttgccctcccttctgcccagggcccagtgttcttgatagaagacccttctggggagccagggagctcaggggacagataagggaaggacgccccctgactccaggcccctgagcctggcgggaagtggctgcggcccaggcagccagtcctggtggtgttctccctgcatgccctccgtggctgggctgccaccccacccggcccgaatctgtcttgacctgcaggaatacacgggcggcgccaggcattacctcacagcgggactacacagttgctggctttgctcctgggcaaggaggagcaggccagagcctcttttgcttccttttcttgcccatgccgcttctagaagccaggcacaggttgccaagaggtgacacgaaacaggaggaaactcagtgacctctgcctctcccacattcctccccgcgggggaggacctcgccgctctgaagagcaccgtgcacatgtgggtgcacaaacgtgggtgttggtgtggacggggcgcagatctccgtggatgaactgcgtctggactcttagattcataaaatattcgagggtttgggagtcacagaccctcccctctcctcagtgcactttggcatttgcacggtgtcttccccggacagcacagcaataaatggtgtgattgcgtgga

SEQ ID NO: 290104 - DNA, 2891 bp, Homo sapiens
gcgctgccgccgccgctttcgcccgggagccgggggccgggcgccatcatgctgagccggctcggggcgctgctgcaggaagccgtgggggcgcgcgagcccagcattgacctgctgcaggccttcgtggagcactggaagggcatcacgcactactacatcgagagcacagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctgagccagcaccagggcggtgggagactcctgtccacacctctgccccagagctgcctcctgcctggcactgccgccacactcccctcctgggatggggcttctgctcccgggctcactcaaggagactgcggcatgttgaccacaccagactgggtttcagggaatgggcatgccaggtgccaaggagccaaacagatggctttccaggcagcaaggtccttggggccttcttggaggagcttgggtgacagccaggtgagcacccagaccccagaccctcatgtgctgtgtgcctggccccttctgtactggccatttgtggccagggccaagcctgtgactcaactccaggggcaagatggggagtgagctgatggctccgagactggtcaggagcccaggccagtgagatggggcctggagccttgtctgtgtcacattaggtaccatgggagctgctgagacctgacattttgtcccctgcctacatggcttggcccatggagaaggagcagtgaatgggatcgtcggggaagcccctcttcctgctctgctcccctggaaactgttgcaaaactcccagccgcggagtccgatccggggtcgagctgg

SEQ ID NO: 290105 - DNA, 1208 bp, Homo sapiens
gcgctgccgccgccgctttcgcccgggagccgggggccgggcgccatcatgctgagccggctcggggcgctgctgcaggaagccgtgggggcgacaactccaggaccttgttggggtgcaggacgcccttcccgtcaccccgggacgtgggaagtgcaggccctgccggtccaagtccccacgaaggcgcgagcccagcattgacctgctgcaggccttcgtggagcactggaagggcatcacgcactactacatcgagagcacaggtaacctgcccagtcgttcagaattggagccgagttcacggagacagagaaccagacagacagaagacccagagccctgggccactccactcctgatgatttagctgccggtcccactctgaccttttggaaagaggctgtgtgaggaaggagtagcctggttgggggtctcactggcctgactctgcaaggaagaggtggctgcacttcccccagcttccagctccagaccttcaggccccagatgaaagcacccccgccaagaagacagacattccctggcggctgaagcagatgctggatatcctggtgtatgaagagcagcagcaggcggccgcgggtgaggcagggccctgcctggagtacctgctgcagcacaagatcctggagactctctgcacgctgggcaaggccgaggtgggaggccctctgcgcgctgggccaggccgaggtgggaggcctctgcgcgcttggccaggccgaggtgggaggcctctgtgcgctgggccaggccgaggtgggagaccctctgagtgctgggccaggctgaggtgggcggtgggcagtgggcagcctggggctccctggattccaggcctttctgcctatgctcttcccagtcctgacactgaaagtggcagttcgggcgagaggagcaaacaggacgggcactgtggctgtctcacttagaacactccaccatcccagcgctcctgttcccagttcactccacaaagatgggcctgccatgtgccaggctctgctctagatgctggggacacagcagggattcatactgacaagagccaggcatggtgatgcgtgcctgtagccccagctacgtgggaggccgaggtgggtggattgcttgagcccaggagatggaggctgcagtgaactgttatcgtgagaccgcactcctgcctaggaggcagagcaaga

SEQ ID NO: 290106 - DNA, 1040 bp, Homo sapiens
agctcggtacccgccgccgggattcctacgcactactacatcgagagcacaggtgcggcctggccctccccagcccagggaccctggagggagcggggaggaaggagtgtgcagagtgtcaccattcaggtgtcctgggaaaggtaacctgcccagtcgttcagaattggagccgagttcacggagacagagaaccagacagacagaagacccagagccctgggccactccactcctgatgatttagctgccggtcccactctgaccttttggaaagaggctgtgtgaggaaggagtagcctggttgggggtctcactggcctgactctgcaaggaagaggtggctgcacttcccccagcttccagctccagaccttcaggccccaggtgcttgtgcctaggatttaatgatcaaaagaaaagaatttaataaattcccctttcccctgagccagcttaggggcaatgtccttgtagagatctggggtaggaggagaacgaaaaccaaggtgggtaacatgcctgggtccctctctccaagctgacaccccaaagagccaaagccttggcacctggtcccatcaggaccgctcactgaggggatggcatctgagtggctgctctgcagtcatgaggctgccatgggtggatacggactggttgccaggtaaccatatcctgcatccctcacttttcccttcctggagttcatactggggcttgatcccagcccacacctttcctacaggctttctttccagcccgggccagcccaggaaattcagaaatctgtgggaccctctgagggttctgctagaccaggtttctcaatcttggcacagttggcattggacctggagccttccctgcgcggggctgtcctgggcggtgtgggatgtgcagcagtaattctggcctctacccactaggtgccagtagcacaccccacccccgaattgggacaaccaggaaggtctccagacattgcctcatgttccctgggggggaaaagcgcacccctggttctgaacctatctctt

SEQ ID NO: 290107 - DNA, 2042 bp, Homo sapiens
aaagggccggctgtttcggcggccgcgggatgcccctgcgctgaccgccaggggcaggtgcccgcccgcgtagacgcacccggcctgaccccgcgccaccatgtaaacggcgccagcaggcggacgctggcttctccgcctgggacccctccgccccgacccgggccccgcggccctcgatgaggacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcgga

SEQ ID NO: 290108 - DNA, 2628 bp, Homo sapiens
aaagggccggctgtttcggcggccgcgggatgcccctgcgctgaccgccaggggcaggtgcccgcccgcgtagacgcacccggcctgaccccgcgccaccatgtaaacggcgccagcaggcggacgctggcttctccgcctgggacccctccgccccgacccgggccccgcggccctcgatgaggacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcggaaaaaaaaaaaaaaaaaaaaaaaaaaaaaaaaaaaaaaaagggggccccttggaatttaaaaaaaccacccatgaaaacccaaaaattttttgcccagggttctctcaaacacccacagggacaccttcagtataaatctcacggggccagaatttcctaccactcccgtggggagagacccccggtaaaccaaacccctgctttggcaaagtgcttctacaagggagatggcattaaagaacccgacccccttaaggggaggcccttgtaaacccctctttagaggcagacaccctcggacgctcgtcggccaactaaacatttcgcgccttgtaagagacccccctctccccatataaggatgtgtttcgtgacccctttttgtctattacacccgctttgctttaaacaacacagaggggggcgtataaaatttacccaggcgccaagcttgcctacccatttgttgcacggggccataggggtgaaatagaggcaggcgttaacaccgtgggacacgtctggttggagaccctcggcgtattcgaccctcaatagcggcaatcgaggtcaccttcgcattgta

SEQ ID NO: 290109 - DNA, 2030 bp, Homo sapiens
aaagggccggctgtttcggcggccgcgggatgcccctgcgctgaccgccaggggcaggtgcccgcccgcgtagacgcacccggcctgaccccgcgccaccatgtaaacggcgccagcaggcggacgctggcttctccgcctgggacccctccgccccgacccgggccccgcggccctcgatgaggacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggaattcatttatcattgttttaagaatcgtaccttttcctgtaatcttattc

SEQ ID NO: 290110 - DNA, 1896 bp, Homo sapiens
tggccgctcacgtggtattacgtggcccgtacgtgattgacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcgga

SEQ ID NO: 290111 - DNA, 2193 bp, Homo sapiens
aaagggccggctgtttcggcggccgcgggatgcccctgcgctgaccgccaggggcaggtgcccgcccgcgtagacgcacccggcctgaccccgcgccaccatgtaaacggcgccagcaggcggacgctggcttctccgcctgggacccctccgccccgacccgggccccgcggccctcgatgaggacacaccatgctgaccggggtgaccgacggtatcttctgttgcctgctgggcacgccccccaacgccgtggggccactggagagcgtcgagtccagcgatggctacacctttgtagaggtcaagcccggggcccggcggtgcttgcggggctggaaggccattgccccacggggaaaacccccggtgcgagaccgccgccaatggcccaccgtgtgaccatttggggccacggcccgccctcccaaaagagggcaccgcctttttacccggccccaataaacaccggcccataacttttcccaattcctgcgaatccctcgggaatgccagccccaggggggggacccgttcttcgcgggggccttttgggggtcccaggcgttgttcaggcggccgggaatcacccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcgga

SEQ ID NO: 290112 - DNA, 244 bp, Homo sapiens
tgggtgatatagaggatccccgccgagcagcacccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcgga

SEQ ID NO: 290113 - DNA, 1208 bp, Homo sapiens
aaagggccggctgtttcggcggccgcgggatgcccctgcgctgaccgccaggggcaggtgcccgcccgcgtagacgcacccggcctgaccccgcgccaccatgtaaacggcgccagcaggcggacgctggcttctccgcctgggacccctccgccccgactagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcgga

SEQ ID NO: 290114 - DNA, 911 bp, Homo sapiens
ggcttctgcaacagttctcggatcacgctgtcgtaggacttgcggatgttggagcggcccaccttctccgccgtagcgatgcagatgttgcgcaggcgggcttcctgctcgaaggcctcgatccctgtctccccgtaatcaccctcggaggctactgtggacacatggctacatttttctgttagttcttgagatgaataccagatgcttccttggatactgtattttggacactaggaagcaggtctcacacaggactaggagactctggacaaaatggcctatactgacttatttaggcataggaatattgcttcactcagcctgactgaaatggcaggtgtcaccaaacaggtactgtcattacttctagaatgagtgcctggcttccactggatttatgtaccactatggaaggcttggtgataggagccctgtctatgcatagcttgactttgttaagaggtttctggctagcactggagaggccatctcttcttgatacaatgattttctcatcttcaagttatattaatcaggacctgaacccctcagggagacagagaatgaaaggacctaaaaaatatctggacattattttctggcagcgaagaatcacagtgaaacaatcctaaactgctgaaatttcctctcccataggggtaggagtaatgagaaactgctcaaaaaaaaaacaaaaaagttcttgtttttcaatgataggcttcatgtctaactctccaggatgtacgagaataatttacaatgaaggcaggctttgcaagagaacgaactagccatagaataacagcaatgtgggaaagattctctgcattggaaaggggcacaatgagctgtaactttggggaaggctgtgggctagaataaaacagcaactattgccaacattt

SEQ ID NO: 290115 - DNA, 401 bp, Homo sapiens
ggtggtggcccagttagagaagaggcgtggccagcatcagggaaggcaacctcaaaggatcctggagagtggaggggaggacggcctgtgtagtaaagcccttcccccagggcttggtccttggtcctgcattctgatctagcctggctagggctaggctggccctagctcacaggacgtactgtcatgcactgtgtcctctggatcctggagagggccctcagtcttagaagtgctcagtaagtatttgtacaatgaattccaggatccaacttgaactggagaccccagctggtggcctatgacccaaatccatccctgggatgtgttatatttggcctggaaagtgtttaaaagaaaatgaaccagttgccaacatataaaatttggaatgtcaaata

SEQ ID NO: 290116 - DNA, 1359 bp, Homo sapiens
gaaacctcctcgtctgtgcacgaacaggtggccgactctggagcccaggctgttgctttccagtctggtggtgaatcctccatagtctggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacgtcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctggcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaac

SEQ ID NO: 290117 - DNA, 1193 bp, Homo sapiens
gaaacctcctcgtctgtgcacgaacaggtggccgactctggagcccaggctgttgctttccagtctggtggtgaatcctccatagtctggaacagccagctgaaaactctcctggccattggaggctggaacttcgggactgccccgaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacgtcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctggcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaac

SEQ ID NO: 290118 - DNA, 1684 bp, Homo sapiens
  misc_feature (373)..(373): n is a, c, g, or t
gaaacctcctcgtctgtgcacgaacaggtggccgactctggagcccaggctgttgctttccagtctggtggtgaatcctccatagtctgaagcctttgtgataaccacagaatcagaacatataaaaagctctgcgggactggtgctgactgcaaccatgacaaagcttattctcctcacaggtcttgtccttatactgaatttgcagctcggctctgcctaccagctgacatgctacttcaccaactgggcccagtaccggccaggcctggggcgcttcatgcctgacaacatcgacccctgcctctgtacccacctgatctacgcctttgctgggaggcagaacaacgagatcaccaccatcgaatggaangatgtgactctctaccaagctttcaatggcctgaaaaataagaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacgtcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctggcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaac

SEQ ID NO: 290119 - DNA, 1482 bp, Homo sapiens
gaaacctcctcgtctgtgcacgaacaggtggccgactctggagcccaggctgttgctttccagtctggtggtgaatcctccatagtctgaagcctttgtgataaccacagaatcagaacatataaaaagctctgcgggactggtgctgactgcaaccatgacaaagcttattctcctcacaggtcttgtccttatactgaatttgcagctcggaacagccagctgaaaactctcctggccattggaggctggaacttcgggactgcccctttcactgccatggtttctactcctgagaaccgccagactttcatcacctcagtcatcaaattcctgcgccagtatgagtttgacgggctggactttgactgggagtaccctggctctcgtgggagccctcctcaggacaagcatctcttcactgtcctggtgcaggaaatgcgtgaagcttttgagcaggaggccaagcagatcaacaagcccaggctgatggtcactgctgcagtagctgctggcatctccaatatccagtctggctatgagatcccccaactgtcacagtacctggactacatccatgtcatgacctacgacctccatggctcctgggagggctacactggagagaacagccccctctacaaatacccgactgacaccggcagcaacgcctacctcaatgtggattatgtcatgaactactggaaggacaatggagcaccagctgagaagctcatcgttggattccctacctatggacacaacttcatcctgagcaacccctccaacactggaattggtgcccccacctctggtgctggtcctgctgggccctatgccaaggagtctgggatctgggcttactacgagatctgtaccttcctgaaaaatggagccactcagggatgggatgcccctcaggaagtgccttatgcctatcagggcaatgtgtgggttggctatgacaacgtcaagagcttcgatattaaggctcaatggcttaagcacaacaaatttggaggcgccatggtctgggccattgatctggatgacttcactggcactttctgcaaccagggcaagtttcccctaatctccaccctgaagaaggccctcggcctgcagagtgcaagttgcacggctccagctcagcccattgagccaataactgctgctcccagtggcagcgggaacgggagcgggagtagcagctctggaggcagctcgggaggcagtggattctgtgctggcagagccaacggcctctaccccgtggcaaataacagaaatgccttctggcactgcgtgaatggagtcacgtaccagcagaactgccaggccgggcttgtcttcgacaccagctgtgattgctgcaactgggcataaacctgacctggtctatattccctagagttccagtctcttttgcttaggacatgttgcccctacctaaagtcctgcaataaaatcagcagtcaaaac

SEQ ID NO: 290120 - DNA, 3823 bp, Homo sapiens
  misc_feature (3823)..(3823): n is a, c, g, or t
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccgaaaaaaaaaaaaaaaaaaaaaaaaaaaaaaattgtgggggacgcagcgggcccccgaaacacggctcaaagaaaccaaacgatatggagcacggaggcccacaagggaaagcgaaacggggcacaaaggtgatccccagggaacaccggggacagacacaagggacgaaaatctacaccaataan

SEQ ID NO: 290121 - DNA, 3637 bp, Homo sapiens
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctcc

SEQ ID NO: 290122 - DNA, 3517 bp, Homo sapiens
  misc_feature (3517)..(3517): n is a, c, g, or t
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccgaaaaaaaaaaaaaaaaaaaaaaaaaaaaaaattgtgggggacgcagcgggcccccgaaacacggctcaaagaaaccaaacgatatggagcacggaggcccacaagggaaagcgaaacggggcacaaaggtgatccccagggaacaccggggacagacacaagggacgaaaatctacaccaataan

SEQ ID NO: 290123 - DNA, 3577 bp, Homo sapiens
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctcc

SEQ ID NO: 290124 - DNA, 2576 bp, Homo sapiens
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacggtaaggcgggagggctgccctgttgccggggagtgggacccggggcttcggcatcaaccaagacctgcacagttacgagacctgcacagagaccatcttctctggtctcttaaaaaagtctagagactttgtcagtttttctctggcccacagagaaaggcaggggataaaatctggcaacttgagccaggtgcggtggctcacacctgtaatcccagcactttgggaggttgaggtgggtggatcacctgaggttgggagttcaagaccagcctgaccaatgtggagaaaccccgtctctactaaaaatacaaaaatagcagggcgtcatggtggcatgcatctgtaatcctagctacttgggaggctgaggccaaagaatcacttgaacccgggaggtggagtttgcagtgagctgagatcacgccactgcactcgagccttggtgccagagtgagactctgtctggaaaaaaaaagaaaaacctgttataatcacatgcttcaaaattggagtgacacagaagggtatgaggcgccaggtctccctgtcaccatgccctcctgcccgctcccatgcaggcccacacaagcttcctct

SEQ ID NO: 290125 - DNA, 2241 bp, Homo sapiens
  misc_feature (2241)..(2241): n is a, c, g, or t
ggaaggactcgatactcacatttcaaaaggaagttgtaaaatgtacggtctgtgcctggggtgagaagccctcgtgccttcctggcatgctgcaggttcccgtttaagttgctcagccagatctgattgtgctggtcaggctcacctgccaggtgagtgcgcggccggcctcacgtggagatgtgcctggtgtgcctggcagagccctttcaggctttgctttctaggagagtggtggaggaaatcagtcatttcaaaaccttttgtttttcttttgtacagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccgaaaaaaaaaaaaaaaaaaaaaaaaaaaaaaattgtgggggacgcagcgggcccccgaaacacggctcaaagaaaccaaacgatatggagcacggaggcccacaagggaaagcgaaacggggcacaaaggtgatccccagggaacaccggggacagacacaagggacgaaaatctacaccaataan

SEQ ID NO: 290126 - DNA, 1382 bp, Homo sapiens
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctgggtccacacaagcttcctcttctaaactcagaccaagacagccgtcctcaccgtgctggtgcagacctgctctctctgtgtctctcctggacaccagatgccttcctgcggagctgcctgcagagagccttgctgttctccccaactcggaattccatggaggaagctcctcaggcctgggctgttgctggagttcagtggctcctctcccagt

SEQ ID NO: 290127 - DNA, 3481 bp, Homo sapiens
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagccttaaaaaaaaccggcgcggccg

SEQ ID NO: 290128 - DNA, 3880 bp, Homo sapiens
  misc_feature (3880)..(3880): n is a, c, g, or t
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctcgctccctctcagggcggagctcggggagcctcgggtcgccgcagccgtgcttcgggtcttcgcgtgattcagggctgcaccattcccctgcgcccaccggcgctcccggaacgtgtgtggactctgtgagccgatggctcgtcgtggctgggtcttcacataaagccgtggacgacaggaccggtcgacgccccgaggacctgcttcgactcgcacggggccgctcgtgagtactcttcttcagcttatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccgaaaaaaaaaaaaaaaaaaaaaaaaaaaaaaattgtgggggacgcagcgggcccccgaaacacggctcaaagaaaccaaacgatatggagcacggaggcccacaagggaaagcgaaacggggcacaaaggtgatccccagggaacaccggggacagacacaagggacgaaaatctacaccaataan

SEQ ID NO: 290129 - DNA, 3711 bp, Homo sapiens
  misc_feature (3711)..(3711): n is a, c, g, or t
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccgaaaaaaaaaaaaaaaaaaaaaaaaaaaaaaattgtgggggacgcagcgggcccccgaaacacggctcaaagaaaccaaacgatatggagcacggaggcccacaagggaaagcgaaacggggcacaaaggtgatccccagggaacaccggggacagacacaagggacgaaaatctacaccaataan

SEQ ID NO: 290130 - DNA, 3331 bp, Homo sapiens
  misc_feature (3331)..(3331): n is a, c, g, or t
gaatgtcccttgctcttttcgtgtgaaaaggtgaagttcaacattgccactgatctgggcgcagttcggcagggcaccgcctccccttggagctgtgtggccttagcggagtggccgagcctctctgtgcccagcgtttcattcctacctcctaggtgctaattcctcacaacagactatttttcggctgaggcagtcagggcccccgcccccgtgccctggcgccaagcactcgccccagaatcggtcctgggaataaaggtcaaaaaggaacccttaaacccgctcctccccggaaggcacagcgcctccccttctctccagcccgcgactgcccatccaaaccgaggcctcgcggggcgagtcccttgtcctccagctcgttgaactggggccccgggcacaggtcggctggaccagcttggcgaaccggacagctgcgagaccctcaggtgcccaccggcccagtttccgcccgcccctccgggcccgcctctcattggctcgcgtcccaccaaaccctaccccctggccgtcacttccgggcaacggagcccgtggaaggcggaagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtcacttggcttgtgattaccatttcgtctttaaagcaggtttgttaacagttttaacactcggagtatttaaagccagccaggtgtgggcgtgcctgcacccagatgtggaggtttattttaaggctgtgccccaaggggacccagtttgggggtggctgtgcccgccctggtcctagcatagccctggcccagagcactgctcccacaccctcgggcctcggagctcggctgtgttcatctacagggatctgtcacctgtccctccaggaaagctccttacgcctttgctctcctgagaataaaacttgctctgaatcctcctccgaaaaaaaaaaaaaaaaaaaaaaaaaaaaaaattgtgggggacgcagcgggcccccgaaacacggctcaaagaaaccaaacgatatggagcacggaggcccacaagggaaagcgaaacggggcacaaaggtgatccccagggaacaccggggacagacacaagggacgaaaatctacaccaataan

SEQ ID NO: 290131 - DNA, 994 bp, Homo sapiens
ggaaggactcgatactcacatttcaaaaggaagttgtaaaatgtacggtctgtgcctggggtgagaagccctcgtgccttcctggcatgctgcaggttcccgtttaagttgctcagccagatctgattgtgctggtcaggctcacctgccaggtgagtgcgcggccggcctcacgtggagatgtgcctggtgtgcctggcagagccctttcaggctttgctttctaggagagtggtggaggaaatcagtcatttcaaaaccttttgtttttcttttgtacagcaaaaagatggcacctttgcagcagggggctacatgccccctctccggtttaaagcacttaccctctctgtggtgtttggaaccatggttggtggcatccttatccccaacggtaaggcgggagggctgccctgttgccggggagtgggacccggggcttcggcatcaaccaagacctgcacagttacgagacctgcacagagaccatcttctctggtctcttaaaaaagtctagagactttgtcagtttttctctggcccacagagaaaggcaggggataaaatctggcaacttgagccaggtgcggtggctcacacctgtaatcccagcactttgggaggttgaggtgggtggatcacctgaggttgggagttcaagaccagcctgaccaatgtggagaaaccccgtctctactaaaaatacaaaaatagcagggcgtcatggtggcatgcatctgtaatcctagctacttgggaggctgaggccaaagaatcacttgaacccgggaggtggagtttgcagtgagctgagatcacgccactgcactcgagccttggtgccagagtgagactctgtctggaaaaaaaaagaaaaacctgttataatcacatgcttcaaaattggagtgacacagaagggtatgaggcgccaggtctccctgtcaccatgccctcctgcccgctcccatgcaggcccacacaagcttcctct

SEQ ID NO: 290132 - DNA, 2115 bp, Homo sapiens
gccgaggtacgcggtgcggtctcccggtacccggagcggctctgatagagacggggtttcaccgtgttggccagaatggtctcgatctcctgacctcgtgatctgcccgcctcgggcctcccaaagtgctggaattacaggtgtgagccacggcgccgggccccctagggattttcaggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatctt

SEQ ID NO: 290133 - DNA, 1995 bp, Homo sapiens
gccgaggtacgcggtgcggtctcccggtacccggagcggctctgatagggattttcaggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatctt

SEQ ID NO: 290134 - DNA, 1357 bp, Homo sapiens
gactctgaggatccccaagtaagtcgggacgcgagttcgtcgggaccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatctt

SEQ ID NO: 290135 - DNA, 461 bp, Homo sapiens
gggatgggtgttttccttttctctttcctagaggttctatgtagctctactgggattttcattcttggtcttaaagtgagccatgcacaaacctagccattcctgattgtctctaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgaggtgaggaccacccattagactcctattcagtgccccaggcccctgtggttggagaagcagaataattagtaattcttggttgtgaggtgatttcatagattgacttgattagttgggctgactgggtggaaatagtcccctttcctccccca

SEQ ID NO: 290136 - DNA, 1820 bp, Homo sapiens
gccgaggtacgcggtgcggtctcccggtacccggagcggctctgatagagacggggtttcaccgtgttggccagaatggtctcgatctcctgacctcgtgatctgcccgcctcgggcctcccaaagtgctggaattacaggtgtgagccacggcgccgggccccctagggattttcaggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatctt

SEQ ID NO: 290137 - DNA, 2273 bp, Homo sapiens
gccgaggtacgcggtgcggtctcccggtacccggagcggctctgatagagacggggtttcaccgtgttggccagaatggtctcgatctcctgacctcgtgatctgcccgcctcgggcctcccaaagtgctggaattacaggtgtgagccacggcgccgggccccctagggattttcaggtttaacttgtggccctaaagaactggaaacccaaaggaacgaatattcctgccccacagagtcccatctttggtgaggctgtttctggagtttacatgatgaccaaggtactaggcatggccccagttctgggccctaggcctccacaggagcaggtggggcctctgatggtaaaagtcgaggagaaagaagagaaaggcaagtaccttcctagcctggagatgttccgccagcgcttcaggcagtttgggtaccatgatacccctggaccccgagaggccctgagccaactccgggtgctctgctgtgagtggctgaggcccgagatccacaccaaggagcagatcctggagctactggtgctggagcagttcctgaccatcctgccccaggagctccaggcctgggtgcaggagcattgcccggagagcgctgaagaggctgtcactctcctcgaagatctggagcgggaactggatgagccaggacaccaggtctcaactcctccaaacgaacagaaaccggtgtgggagaagatatcctcctcaggaactgcaaaggaatccccgagcagcatgcagccacagcccttggagaccagtcacaaatacgagtcttgggggcccctgtacatccaagagtctggtgaggagcaggagttcgctcaagatccaagaaaggtccgagattgcagattgagtacccagcacgaggaatcagcagatgagcagaaaggttctgaagcagaggggctcaaaggggatataatttctgtgattatcgccaataaacctgaggccagcttagagaggcagtgcgtaaaccttgaaaatgaaaaaggaacaaaaccccctcttcaagaggcaggctccaagaaaggtagagaatcagttcctactaaacctaccccaggagagagacgttatatatgtgctgaatgtggcaaagcctttagtaatagctcaaatctcaccaaacacaggagaacacacactggggagaaaccttacgtgtgcaccaagtgtgggaaagctttcagccacagctcaaacctcaccctccactacagaacacacttggtggaccggccctatgactgtaagtgtggaaaagcttttgggcagagctcagaccttcttaaacatcagagaatgcacacagaagaggcgccatatcagtgcaaagattgtggcaaggctttcagcgggaaaggcagcctcattcgtcactatcggatccacactggggagaagccttatcagtgtaacgaatgtgggaagagcttcagtcagcatgcgggcctcagctcccaccagagactccacaccggagagaagccatataagtgtaaggagtgtgggaaagccttcaaccacagctccaacttcaataaacaccacagaatccacaccggggaaaagccctactggtgtcatcactgtggaaagaccttctgtagcaagtccaatctttccaaacatcagcgagtccacactggagagggagaagcaccgtaactttcaagcgctcctgttgttgtcgttgttttaaactttagaatctgaaaaccagaaagaagtcttgtcattgcagcagcatcgattccggtgatagagtttgtatcactcaacatcaggggatgcctgaggagtgcgagctccacagcaacatggcaggcaggaggtcctcagaaggtgtcaggaggttccacactcgccagttcactggagcagagtcccttcgccacacttagggtcccagtaagccatgccagcattaccttttgcgtagttaaacagacgtgtatccagtctagttaaggaagaaacattaagattgtttaatttttaacatatattcaagaattttaatttgtaaagaattgagccacattgaacacaattgaatgagattcagaataaacttataacatcttgtaatgcctcaggactattattataacaaatgatgtgttggttattgaatacttacagatggagaaaactattcctactggtttagcttttttagaaaatttggatttgggggtcaggcacggtggcttacgcctgtaatcccagcaccttggaagcc

SEQ ID NO: 290138 - DNA, 2285 bp, Homo sapiens
tgctccaggccaactggactctgggcggccagcacaggcagggtcagggggtgacttctgtgcctcgtggcactgccacctgggcctgagcaagagggctccattctcctacccgcccaaaccctcatccctgtcctagccccagtgctagaaataaagagaccagaattttccttctggcctaagggccccagaggaatacccactggaactcacagctgcctcatggaaactgctgcagcagtggtgaagctagaaagactagaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaatggaatgtgtgc
